United States Patent
Wong et al.

(10) Patent No.: US 12,024,545 B2
(45) Date of Patent: Jul. 2, 2024

(54) METHODS OF TREATING AGING-RELATED DISORDERS

(71) Applicant: HCW Biologics, Inc., Miramar, FL (US)

(72) Inventors: Hing C. Wong, Miramar, FL (US); Xiaoyun Zhu, Miramar, FL (US); Bai Liu, Miramar, FL (US); Pallavi Chaturvedi, Miramar, FL (US); Varghese George, Miramar, FL (US)

(73) Assignee: HCW Biologics, Inc., Miramar, FL (US)

( * ) Notice: Subject to any disclaimer, the term of this patent is extended or adjusted under 35 U.S.C. 154(b) by 75 days.

(21) Appl. No.: 17/336,183

(22) Filed: Jun. 1, 2021

(65) Prior Publication Data

US 2022/0073578 A1   Mar. 10, 2022

Related U.S. Application Data

(60) Provisional application No. 63/118,536, filed on Nov. 25, 2020, provisional application No. 63/032,933, filed on Jun. 1, 2020.

(51) Int. Cl.
| | |
|---|---|
| *A61K 38/17* | (2006.01) |
| *A61K 39/395* | (2006.01) |
| *A61K 45/06* | (2006.01) |
| *C07K 14/47* | (2006.01) |
| *A61K 38/00* | (2006.01) |

(52) U.S. Cl.
CPC ........ *C07K 14/4703* (2013.01); *A61K 38/179* (2013.01); *A61K 39/3955* (2013.01); *A61K 45/06* (2013.01); *A61K 38/00* (2013.01); *C07K 2317/24* (2013.01); *C07K 2317/73* (2013.01)

(58) Field of Classification Search
CPC ...... A61K 38/00; A61K 38/16; A61K 38/179; A61K 39/3955
See application file for complete search history.

(56) References Cited

U.S. PATENT DOCUMENTS

| | | |
|---|---|---|
| 6,117,980 A | 9/2000 | Gonzalez et al. |
| 7,452,537 B2 | 11/2008 | Bauer et al. |
| 7,482,436 B2 | 1/2009 | Sugimura et al. |
| 7,488,802 B2 | 2/2009 | Collins et al. |
| 7,521,051 B2 | 4/2009 | Collins et al. |
| 7,612,181 B2 | 11/2009 | Wu et al. |
| 7,691,380 B2 | 4/2010 | Thorpe et al. |
| 7,723,482 B2 | 5/2010 | Soulillou et al. |
| 7,968,094 B2 | 6/2011 | Jiao et al. |
| 8,007,795 B2 | 8/2011 | Jiao et al. |
| 8,133,485 B2 | 3/2012 | Levi-Schaffer et al. |
| 8,217,149 B2 | 7/2012 | Irving et al. |
| 8,258,268 B2 | 9/2012 | Wu et al. |
| 8,475,792 B2 | 7/2013 | Dall'Acqua et al. |
| 8,552,156 B2 | 10/2013 | Takayanagi et al. |
| 8,586,714 B2 | 11/2013 | Ghayur et al. |
| 8,716,450 B2 | 5/2014 | Ghayur et al. |
| 8,722,855 B2 | 5/2014 | Ghayur et al. |
| 8,735,546 B2 | 5/2014 | Ghayur et al. |
| 8,741,604 B2 | 6/2014 | Campbell et al. |
| 8,753,640 B2 | 6/2014 | Wu et al. |
| 8,759,494 B2 | 6/2014 | Bachmann et al. |
| 8,822,645 B2 | 9/2014 | Ghayur et al. |
| 9,035,026 B2 | 5/2015 | Hoffmann et al. |
| 9,067,997 B2 | 6/2015 | Romagne et al. |
| 9,085,623 B2 | 7/2015 | Rother et al. |
| 9,090,684 B2 | 7/2015 | Borras et al. |
| 9,226,962 B2 | 1/2016 | Le Gall et al. |
| 9,238,084 B2 | 1/2016 | Liu et al. |
| 9,273,136 B2 | 3/2016 | Rader et al. |
| 9,371,395 B2 | 6/2016 | Takahashi et al. |
| 9,441,034 B2 | 9/2016 | Sivakumar et al. |
| 9,505,843 B2 | 11/2016 | Kim et al. |
| 9,617,345 B2 | 4/2017 | Berne et al. |
| 9,701,758 B2 | 7/2017 | Cooper et al. |
| 11,518,792 B2 | 12/2022 | Wong |
| 11,672,826 B2 | 6/2023 | Wong |
| 11,730,762 B2 | 8/2023 | Wong |
| 11,738,052 B2 | 8/2023 | Wong |

(Continued)

FOREIGN PATENT DOCUMENTS

| | | |
|---|---|---|
| CN | 1844150 | 10/2006 |
| CN | 106255703 | 12/2006 |

(Continued)

OTHER PUBLICATIONS

Bartscht et al. Dasatinib blocks transcriptional and promigratory responses to transforming growth factor-beta . . . Molecular Cancer. 2015, vol. 14:199. (Year: 2015).*

Bird et al. TGF-beta inhibition restores a regenerative response in acute liver injury by suppressing paracrine senescence. Science Translational Medicine. Aug. 15, 2018, vol. 10, No. 454, pp. 1-30. (Year: 2018).*

Cai et al. Quercetin inhibits transforming growth factor beta1-induced epithelial-mesenchymal transition . . . Drug Design, Development and Therapy. 2018, vol. 12, pp. 4149-4161. (Year: 2018).*

Chandrudu et al., "Chemical methods for peptide and protein production," Molecules, 2013, 18(4):4373-4388.

Tam et al., "Methods and strategies of peptide ligation," Peptide Science: Original Research on Biomolecules, 2001, 60(3):194-205.

(Continued)

*Primary Examiner* — Jeffrey E. Russel
(74) *Attorney, Agent, or Firm* — Fish & Richardson P.C.

(57) ABSTRACT

Provided herein are methods of killing or reducing the number of naturally-occurring and/or treatment-induced senescent cells and diseased cells in a subject in need thereof, decreasing the accumulation of naturally-occurring and/or treatment-induced senescent cells and diseased cells in a subject in need thereof, that include administering to the subject a therapeutically effective amount of one or more common gamma-chain family cytokine receptor activating agent(s) and/or one or more agent(s) that result(s) in a decrease in the activation of a TGF-β receptor.

78 Claims, 239 Drawing Sheets

Specification includes a Sequence Listing.

(56) References Cited

U.S. PATENT DOCUMENTS

| | | | |
|---|---|---|---|
| 2001/0044427 A1 | 11/2001 | Mazel et al. | |
| 2003/0124678 A1 | 7/2003 | Epstein et al. | |
| 2003/0219441 A1 | 11/2003 | Thorpe et al. | |
| 2005/0014224 A1 | 1/2005 | Collins et al. | |
| 2006/0159655 A1 | 7/2006 | Collins et al. | |
| 2007/0160579 A1 | 7/2007 | Schmitz et al. | |
| 2008/0025979 A1 | 1/2008 | Honjo et al. | |
| 2009/0148942 A1 | 6/2009 | McDonagh et al. | |
| 2012/0171197 A1 | 7/2012 | Eriksson et al. | |
| 2012/0264920 A1 | 10/2012 | Wang et al. | |
| 2013/0274446 A1 | 10/2013 | Kumagai et al. | |
| 2014/0242077 A1 | 8/2014 | Choi | |
| 2015/0218274 A1 | 8/2015 | Sabatos-Peyton et al. | |
| 2015/0259429 A1 | 9/2015 | Benaroch et al. | |
| 2016/0175397 A1 | 6/2016 | Umana et al. | |
| 2016/0340413 A1 | 11/2016 | Duerner et al. | |
| 2016/0367664 A1 | 12/2016 | Wang et al. | |
| 2017/0051063 A1 | 2/2017 | Baum et al. | |
| 2017/0198042 A1 | 7/2017 | Williams et al. | |
| 2017/0283499 A1 | 10/2017 | Delhem et al. | |
| 2018/0200366 A1 | 7/2018 | Wong | |
| 2019/0078082 A1 | 3/2019 | Amorese et al. | |
| 2019/0092846 A1 | 3/2019 | Ibebunjo et al. | |
| 2019/0177406 A1 | 6/2019 | Ledbetter et al. | |
| 2019/0315850 A1 | 10/2019 | Bedinger et al. | |
| 2020/0071374 A1 | 3/2020 | Wong | |
| 2020/0123607 A1* | 4/2020 | Serrano Marugan | C12Q 1/6883 |
| 2020/0190174 A1 | 6/2020 | Wong | |
| 2020/0392221 A1 | 12/2020 | Van Snick et al. | |
| 2020/0399358 A1 | 12/2020 | Shapiro et al. | |
| 2021/0060064 A1 | 3/2021 | Wong | |
| 2021/0061897 A1 | 3/2021 | Ledbetter et al. | |
| 2021/0070825 A1 | 3/2021 | Wong | |
| 2021/0070826 A1 | 3/2021 | Wong | |
| 2021/0100840 A1 | 4/2021 | Wong et al. | |
| 2021/0137981 A1 | 5/2021 | Wong | |
| 2021/0268022 A1 | 9/2021 | Wong et al. | |
| 2021/0277054 A1 | 9/2021 | Wong et al. | |
| 2021/0338724 A1 | 11/2021 | Wong | |
| 2021/0355204 A1 | 11/2021 | Bedinger et al. | |
| 2021/0403545 A1 | 12/2021 | Van Snick et al. | |
| 2023/0023389 A1 | 1/2023 | Wong | |
| 2023/0039157 A1 | 2/2023 | Wong | |
| 2023/0128292 A1 | 4/2023 | Wong | |
| 2023/0174666 A1 | 6/2023 | Wong et al. | |
| 2023/0272027 A1 | 8/2023 | Wong | |
| 2023/0372399 A1 | 11/2023 | Wong | |
| 2023/0372444 A1 | 11/2023 | Wong et al. | |
| 2023/0381238 A1 | 11/2023 | Wong | |
| 2023/0398151 A1 | 12/2023 | Wong | |

FOREIGN PATENT DOCUMENTS

| | | |
|---|---|---|
| CN | 101653603 | 2/2010 |
| CN | 101965364 | 2/2011 |
| CN | 102153653 | 8/2011 |
| CN | 109513003 | 3/2019 |
| EP | 1245676 | 10/2002 |
| EP | 1719528 | 11/2006 |
| EP | 2537933 | 12/2012 |
| EP | 3029069 | 6/2016 |
| EP | 3348276 | 7/2018 |
| JP | 2005-124568 | 5/2005 |
| JP | 2008-536487 | 9/2008 |
| JP | 2009-512433 | 3/2009 |
| JP | 4361133 | 8/2009 |
| KR | 2016/0127688 | 11/2016 |
| KR | 101778439 | 9/2017 |
| WO | WO 1995/015341 | 6/1995 |
| WO | WO 1996/001653 | 1/1996 |
| WO | WO 2001/083755 | 11/2001 |
| WO | WO 2002/083152 | 10/2002 |
| WO | WO 2003/037911 | 5/2003 |
| WO | WO 2003/104425 | 12/2003 |
| WO | WO 2004/076488 | 9/2004 |
| WO | WO 2006/096828 | 9/2006 |
| WO | WO 2006/097743 | 9/2006 |
| WO | WO 2006/119897 | 11/2006 |
| WO | WO 2008/096158 | 8/2008 |
| WO | WO 2011/127324 | 10/2011 |
| WO | WO 2012/040323 | 3/2012 |
| WO | WO 2012/120125 | 9/2012 |
| WO | WO 2012/170470 | 12/2012 |
| WO | WO 2012/175222 | 12/2012 |
| WO | WO 2012/175692 | 12/2012 |
| WO | WO 2013/068946 | 5/2013 |
| WO | WO 2014/007513 | 1/2014 |
| WO | WO 2014/026054 | 2/2014 |
| WO | WO 2014/095808 | 6/2014 |
| WO | WO 2014/130635 | 8/2014 |
| WO | WO 2014/159531 | 10/2014 |
| WO | WO 2015/089881 | 6/2015 |
| WO | WO 2016/106221 | 6/2016 |
| WO | WO 2016/154585 | 9/2016 |
| WO | WO 2016/166348 | 10/2016 |
| WO | WO 2017/053748 | 3/2017 |
| WO | WO 2017/083612 | 5/2017 |
| WO | WO 2017/149538 | 9/2017 |
| WO | WO 2017/189526 | 11/2017 |
| WO | WO 2018/067825 | 4/2018 |
| WO | WO 2018/075989 | 4/2018 |
| WO | WO 2018/129007 | 7/2018 |
| WO | WO 2018/158350 | 9/2018 |
| WO | WO 2018/183169 | 10/2018 |
| WO | WO 2018/165208 | 12/2018 |
| WO | WO 2019/046313 | 3/2019 |
| WO | WO 2020/047299 | 3/2020 |
| WO | WO 2020/047333 | 3/2020 |
| WO | WO 2020/047462 | 3/2020 |
| WO | WO 2020/047473 | 3/2020 |
| WO | WO 2021/163369 | 8/2021 |

OTHER PUBLICATIONS

Baker et al., "Chronic treatment with the beta(2)-adrenoceptor agonist prodrug BRL-47672 impairs rat skeletal muscle function by inducing a comprehensive shift to a faster muscle phenotype," J Pharmacol Exp Ther., Oct. 2006, 319(1):439-446.

Baker et al., "Effects of conjugated linoleic acid (CLA) on tissue composition parameters in a murine cachexia model," The FASEB Journal, Mar. 2006, 20(4), 2 pages (Abstract Only).

Berry et al., "Cancer Anorexia and Cachexia: Screening in an Ambulatory Infusion Service and Nutrition Consultation," Clin J Oncol Nurs., 2018, 22(1):63-68.

Chang et al., "Association Between Sarcopenia and Cognitive Impairment: A Systematic Review and Meta-Analysis," J Am Med Dir Assoc., Dec. 1, 2016, 17(12):1164e7-1164e15, 9 pages.

Chen et al., "Circulating levels of resistin and risk of type 2 diabetes in men and women: results from two prospective cohorts," Diabetes Care, Feb. 2009, 32(2):329-334.

Cosgrove et al., "Usher protein functions in hair cells and photoreceptors," Int J Biochem Cell Biol., Jan. 2014, 46:80-89.

Helman et al., "Effects of ageing and senescence on pancreatic β-cell function," Diabetes Obes Metab., Sep. 2016, 18(Suppl. 1):58-62.

Jeon et al., "Local clearance of senescent cells attenuates the development of post-traumatic osteoarthritis and creates a pro-regenerative environment," Nat Med., Jun. 2017, 23(6):775-781.

Kim et al., "Insulin resistance, inflammation, and nonalcoholic fatty liver disease in non-obese adults without metabolic syndrome components," Hepatol Int., Jun. 2013, 7(2):586-591.

Kuyinu et al., "Animal models of osteoarthritis: classification, update, and measurement of outcomes," J Orthop Surg Res., Feb. 2, 2016, 11:19, 27 pages.

Melk et al., "Expression of p16INK4a and other cell cycle regulator and senescence associated genes in aging human kidney," Kidney Int., Feb. 2004, 65(2):510-520.

(56) References Cited

OTHER PUBLICATIONS

Melk et al., "Senescence of renal cells: molecular basis and clinical implications," Nephrology Dialysis Transplantation, Dec. 2003, 18(12):2474-2478.
Price et al., "Comparison of collagenase-cleaved articular cartilage collagen in mice in the naturally occurring STR/ort model of osteoarthritis and in collagen-induced arthritis," Osteoarthritis Cartilage, Mar. 2002, 10(3):172-179.
Sousa-Victor et al., "Geroconversion of aged muscle stem cells under regenerative pressure," Cell Cycle, Oct. 15, 2014, 13(20):3183-3190.
Xu et al., "Celecoxib attenuates cachectic events in mice by modulating the expression of vascular endothelial growth factor," Mol Med Rep., Jan. 2015, 11(1):289-294.
[No Author Listed], "CN Br-activated Sepharose 4 Fast Flow," 1999, Affinity Chromatography, 4 pages.
Brämer et al., "Membrane adsorber for the fast purification of a monoclonal antibody using protein a chromatography," Membranes, Nov. 27, 2019, 9(12):159, 15 pages.
Chabannon et al., "Manufacturing natural killer cells as medicinal products," Frontiers in Immunology, Nov. 15, 2016, 7(504):1-9.
Chan et al., "Molecular mechanisms of natural killer cell activation in response to cellular stress," Cell Death & Differentiation, Jan. 2014, 21(1):5-14.
Chang et al., "The dock and lock method: a novel platform technology for building multivalent, multifunctional structures of defined composition with retained bioactivity," Clinical cancer research, Sep. 15, 2007, 13(18):5586s-5591s.
Guha et al., "Affinity purification of human tissue factor: interaction of factor VII and tissue factor in detergent micelles," Proceedings of the National Academy of Sciences, Jan. 1986, 83(2):299-302.
Hélie et al., "Application of the Protein Maker as a platform purification system for therapeutic antibody research and development," Computational and Structural Biotechnology Journal, Jan. 1, 2016, 14:238-244.
Hui et al., "Butyrate inhibit collagen-induced arthritis via Treg/IL-10/Th17 axis," International immunopharmacology, Mar. 1, 2019, 68: Abstract 1 page.
Info.gbiosciences.com [Online], "G-Biosciences, The Basics of Affinity Purification/Affinity Chromatography," Jul. 31, 2018, retrieved on Apr. 18, 2023, retrieved from URL<https://info.gbiosciences.com/blog/the-basics-of-affinity-purification/affinity-chromatography?utm_campaign=G-Bio+Search+Ads&utm_term=&utm_source=adwords&utm_medium=ppc&hsa_src=g&hsa_ver=3&hsa_cam=737902488&hsa_kw=&hsa_ad=621736020174&hsa_tgt=dsa-460355902483&hsa_mt=&hsa_acc-6752996364&hsa_grp=92226101427&hsa_net=adwords&gclid=CjwKCAjw_ihBhADEiwAXEazJvXifVFgeRGV_W99XbY72eRROhWnHtdd695ydPgyh8qdvTwd9ikGIRoCdecQAvD_BWE>, 5 pages.
Klingemann et al., "Natural killer cells for immunotherapy—advantages of the NK-92 cell line over blood NK cells," Frontiers in immunology, Mar. 14, 2016, 7(91): 1-7.
Kozlowska et al., "Adoptive transfer of osteoclast-expanded natural killer cells for immunotherapy targeting cancer stem-like cells in humanized mice," Cancer Immunology, Immunotherapy, Jul. 2016, 65:835-845.
Li et al., "Lipid metabolism fuels cancer's spread," Cell metabolism, Feb. 7, 2017, 25(2):228-230.
Putnam et al., "Clinical grade manufacturing of human alloantigen-reactive regulatory T cells for use in transplantation," American journal of transplantation, Nov. 1, 2013, 13(11):3010-3020.
ThermoFisher.com [Online], "Covalent Immobilization of Affinity Ligands," 2018, retrieved on Apr. 18, 2023, retrieved from <URLhttps://www.thermofisher.com/us/en/home/life-science/protein-biology/protein-biology-learning-center/protein-biology-resource-library/pierce-protein-methods/covalent-immobilization-affinity-ligands.html>, 13 pages.
Uppendahl et al., "Natural killer cell-based immunotherapy in gynecologic malignancy: a review," Frontiers in immunology, Jan. 5, 2018, 8(1825): 1-15.

Urh et al., "Affinity chromatography: general methods," Methods in enzymology, Jan. 1, 2009, 463: 23 pages.
Veluchamy et al., "The rise of allogeneic natural killer cells as a platform for cancer immunotherapy: recent innovations and future developments," Frontiers in immunology, May 31, 2017, 8(631): 1-20.
Wilchek et al., "Essentials of biorecognition: The (strept) avidin-biotin system as a model for protein-protein and protein-ligand interaction," Immunology letters, Feb. 28, 2006, 103(1): Abstract 2 pages.
Zhang et al., "Depletion of NK cells improves cognitive function in the Alzheimer disease mouse model," The Journal of Immunology, Jul. 15, 2020, 205(2): 10pages.
Zhou, "Emerging mechanisms and applications of low-dose IL-2 therapy in autoimmunity," Cytokine & Growth Factor Reviews, Jun. 30, 2022, 67: 80-88.
PCT International Search Report and Written Opinion in International Appln. No. PCT/US2021/029920, dated Oct. 6, 2021, 21 pages.
PCT International Search Report and Written Opinion in International Appln. No. PCT/US2021/035285, dated Oct. 18, 2021, 14 pages.
PCT International Preliminary Report on Patentability in International Appln. No. PCT/US2020/038717, dated Dec. 30, 2021, 9 pages.
Huang et al., "Targeting the vasculature of colorectal carcinoma with a fused protein of (RGD) 3-tTF" The Scientific World Journal, 2013(637086):1-11, 2013.
PCT International Preliminary Report on Patentability in International Appln. No. PCT/US2021/029920, dated Nov. 10, 2022, 11 pages.
International Preliminary Report on Patentability in International Appln. No. PCT/US2020/035598, mailed Dec. 6, 2022, 7 pages.
International Preliminary Report on Patentability in International Appln. No. PCT/US2021/035285, mailed Dec. 15, 2022, 7 pages.
Mikayama et al., "Molecular cloning and functional expression of a cDNA encoding glycosylation-inhibiting factor," Proc. Natl. Acad. Sci. USA, Nov. 1, 1993, 90(21):10056-10060.
Voet et al., Biochemistry, John Wiley & Sons, Inc., 1990, pp. 126-128 and 228-234, 12 pages.
PCT International Preliminary Report on Patentability in International Appln. No. PCT/US2021/017620, dated Aug. 25, 2022, 12 pages.
PCT International Preliminary Report on Patentability in International Appln. No. PCT/US2021/017621, dated Aug. 25, 2022, 8 pages.
PCT International Preliminary Report on Patentability in International Appln. No. PCT/US2021/017714, dated Aug. 25, 2022, 12 pages.
Li et al., "Transforming Growth Factor-β Regulation of Immune Responses," Annu. Rev. Immunol., 2006, 24:99-146.
McCarron et al., "TGF-β prevents T follicular helper cell accumulation and B cell autoreactivity," J Clin Invest., 2014, 124(10):4375-4386.
Voelker et al., "Anti-TGF-β1 Antibody Therapy in Patients with Diabetic Nephropathy," J Am Soc Nephrol., 2017, 28:953-962.
Wallace et al., "B lymphocytes confer immune tolerance via cell surface GARP-TGF-β complex," JCI Insight., 2018, 3(7):e99863, 19 pages.
Abbott et al., "Genomic organization, exact localization, and tissue expression of the human CD26 (dipeptidyl peptidase IV) gene," Immunogenetics, Sep. 1994, 40(5):331-338.
Abdul-Aziz et al., "Acute myeloid leukemia induces protumoral p16INK4a-driven senescence in the bone marrow microenvironment," Blood, Jan. 31, 2019, 133(5):446-456.
Aertgeerts et al., "Crystal structure of human dipeptidyl peptidase IV in complex with a decapeptide reveals details on substrate specificity and tetrahedral intermediate formation," Protein Science, Feb. 2004, 13(2):412-421.
Ait-Oufella el al., "Natural regulatory T cells control the development of atherosclerosis in mice," Nature Medicine, Feb. 5, 2006, 12:178-180.

(56) References Cited

OTHER PUBLICATIONS

Akbari, et al., "Design, expression and evaluation of a novel humanized single chain antibody against epidermal growth factor receptor (EGFR)," Protein Expr. Purif., 2016, 127:8-15.
Ali et al., "Regulatory T cells in skin," Immunology, Jul. 12, 2017, 152(3):372-381.
Angevin et al., "First-in-human phase 1 of YS110, a monoclonal antibody directed against CD26 in advanced CD26-expressing cancers," British Journal of Cancer, Mar. 14, 2017, 116(9):1126-1134.
Bachelet et al., "Mast Cell Costimulation by CD226/CD112 (DNAM-1/Nectin-2) A Novel Interface in the Allergic Process," Journal of Biological Chemistry, Sep. 15, 2006, 281(37):27190-6.
Baker, et al., "Clearance of p16Ink4a-positive senescent cells delays ageing-associated disorders," Nature, 2011, 479(7372): 232-236.
Bennett et al., "Erratum: Killing the old: cell senescence in atherosclerosis," Nature Reviews Cardiology, Jan. 12, 2017, 14(3):132.
Bennett et al., "Killing the old: cell senescence in atherosclerosis," Nature Reviews Cardiology, Dec. 12, 2016, 14(1):8-9, 2 pages.
Bentebibel et al., "A First-in-Human Study and Biomarker Analysis of NKTR-214, a Novel IL2Raf Biased Cytokine, in Patients with Advanced or Metastatic Solid Tumors," Cancer Discovery, Jun. 2019, 9(6):711-721.
Bhat et al., "Astrocyte Senescence as a Component of Alzheimer's Disease," PLoS One, Sep. 12, 2012, 7(9):e45069, 10 pages.
Biran et al., "Senescent cells communicate via intercellular protein transfer," Genes & Development, Apr. 8, 2015, 29(8):791-802, 13 pages.
Borea et al., "Pharmacology of Adenosine Receptors: The State of the Art," Physiological Reviews, May 31, 98(3):1591-1625, (2018).
Borgerding et al., "B-lymphoma cells escape rituximab-triggered elimination by NK cells through increased HLA class I expression," Experimental Hematology, Mar. 1, 2010, 38(3):213-21.
Bork, "Powers and Pitfalls in Sequence Analysis: The 70% Hurdle," Genome Research, 2000, 10:398-400.
Bourgeois et al., "Regulation of cellular senescence via the FOXO4-p53 axis," FEBS Lett., 2018, 592(12): 2083-2097.
Bowie et al., "Deciphering the Message in Protein Sequences: Tolerance to Amino Acid Substitutions," Science, 1990, 247:1306-1310.
Boyman et al., "IL-7/Anti-IL-7 mAb Complexes Restore T Cell Development and Induce Homeostatic T Cell Expansion without Lymphopenia," The Journal of Immunology, Jun. 1, 2008, 180:7265-7275.
Boyman et al., "Selective Stimulation of T Cell Subsets with Antibody-Cytokine Immune Complexes," Science, Mar. 31, 2006, 311(5769):1924-1927.
Brennan et al., "Structural determination of lipid antigens captured at the CD1d-T-cell receptor interface," PNAS, 2017, 114(31):8348-8353.
Brighton et al., "Clearance of senescent decidual cells by uterine natural killer cells in cycling human endometrium," Elife, Dec. 11, 2017, 6:e31274, 23 pages.
Brooks et al., "Combined inhibition of PD1 and CD96 checkpoints improves survival in a resectable murine model of pancreatic cancer," European Journal of Cancer, Jul. 1, 2016, 61:S189, 1 page.
Broxmeyer et al., "Modulation of Hematopoietic Chemokine Effects In Vitro and In Vivo by DPP-4/CD26," Stem Cells and Development, Mar. 4, 2016, 25(8):575-585.
Brunstein et al., "Infusion of Ex Vivo Expanded T Regulatory Cells in Adults Transplanted with Umbilical Cord Blood: Safety Profile and Detection Kinetics," Blood, Jan. 20, 2011, 117(3):1061-1070.
Brunstein et al., "Umbilical cord blood-derived T regulatory cells to prevent GVHD:kinetics, toxicity profile, and clinical effect," Blood, Feb. 25, 2016, 127(8):1044-1051.
Buhling et al., "Functional role of CD26 on human B lymphocytes," Immunology Letters, Feb. 1995, 45(1-2):47-51.
Burgess et al., "Possible Dissociation of the Heparin-binding and Mitogenic Activities of Heparin-binding (Acidic Fibroblast) GrowthFactor-1 from Its Receptor-binding Activities by Site-directed Mutagenesis of a Single Lysine Residue," J. Cell Biol., 1990, 111:2129-2138.
Bussian et al., "Clearance of senescent glial cells prevents tau-dependent pathology and cognitive decline," Nature, Sep. 19, 2018, 562(7728):578-582, 21 pages.
Cai et al., "Chibby suppresses aerobic glycolysis and proliferation of nasopharyngeal carcinoma via the Wnt/β-catenin-Lin28/let7-PDK1 cascade," Journal of Experimental & Clinical Cancer Research, Dec. 1, 2018, 37(1):104.
Cao et al., "Expression and characterization of recombinant humanized anti-HER2 single-chain antibody in Pichia pastoris for targeted cancer therapy," Biotechnology Letters, Jul. 1, 2015, 37(7):1347-54.
Cao, "Self-regulation and cross-regulation of pattern-recognition receptor signaling in health and disease," Nature Reviews Immunology, Dec. 29, 2015, 16(1):35-50.
Carr et al., "NK Cell-Mediated Lysis of Autologous HCMV-Infected Skin Fibroblasts Is Highly Variable among NK Cell Clones and Polyclonal NK Cell Lines," Clinical Immunology, Nov. 2002, 105(2):126-140.
Catania et al., "The tumor-targeting immunocytokine F16-IL2 in combination with doxorubicin: dose escalation in patients with advanced solid tumors and expansion into patients with metastatic breast cancer," Cell Adhesion and Migration, Jan.-Apr. 2015, 9(1-2):14-21.
Cavinato et al., "Molecular mechanisms of UVB-induced senescence of dermal fibroblasts and its relevance for photoaging of the human skin," Experimental Gerontology. Aug. 2017, 94:78-82.
Chalan et al., "Expression of Lectin-Like Transcript 1, the Ligand for CD161, in Rheumatoid Arthritis," PLoS ONE, 2015, 10(7):e0132436.
Chambers et al., "Can blocking inflammation enhance immunity during aging?," Journal of Allergy and Clinical Immunology, May 2020, 145(5):1323-1331.
Chance et al., "A simple and rapid assay of oxidative phosphorylation," Nature, Jun. 1955, 175(4469):1120-1121.
Chattopady hay et al., "Structural Basis of Inducible Costimulator Ligand Costimulatory Function: Determination of the Cell Surface Oligomeric State and Functional Mapping of the Receptor Binding Site of the Protein1," J Immunol., 2006, 3920-3929.
Chen et al., "Sterile inflammation: sensing and reacting to damage," Nature Reviews Immunology, Nov. 19, 2010, 10(12):826-837.
Chichili et al., "Linkers in the structural biology of protein-protein interactions," Protein Science, Feb. 2013, 22(2):153-67.
Childs et al., "Senescent cells: an emerging target for diseases of ageing," Nature Reviews Drug Discovery, Jul. 21, 2017, 16(10):718-735, 18 pages.
Childs et al., "Senescent intimal foam cells are deleterious at all stages of atherosclerosis," Science, Oct. 28, 2016, 354(6311):472-477.
Chinta, et al., "Cellular senescence is induced by the environmental neurotoxin paraquat and bontributes to neuropathology linked to Parkinson's Disease," Cell Rep., 2018, 22(4): 930-940.
Chong et al., "CD36 initiates the secretory phenotype during the establishment of cellular senescence," EMBO Rep., May 18, 2018, 19(6):e45274, 13 pages.
Ciaglia, et al., "Recognition by natural killer cells of N6-isopentenyladensoine-treated human glioma cell lines," Int. J. Cancer, 2018 142(1): 176-190.
Cichocki et al., "GSK3 inhibition drives maturation of NK cells and enhances their antitumor activity," Cancer Research, Oct. 15, 2017, 77(20):5664-75.
Cifaldi et al., "Boosting Natural Killer Cell-Based Immunotherapy with Anticancer Drugs: a Perspective," Trends Molecular Medicine, Dec. 2017, 23(12):1156-1175, 20 pages.
Cipriani et al., "Hippocampal Radial Glial Subtypes and Their Neurogenic Potential in Human Fetuses and Healthy and Alzheimer's Disease Adults," Cerebral Cortex, May 2, 2018, 28(7):2458-2478, 21 pages.
Clayton et al.,"Soluble T Cell Immunoglobulin Mucin Domain 3 Is Shed from CD8 T Cells by the Sheddase ADAM10, Is Increased in Plasma during Untreated HIV Infection, and Correlates with HIV Disease Progression," J Virol., 2015, 89(7):3723-3736.

(56) References Cited

OTHER PUBLICATIONS

Collado et al., "Senescence in tumours: evidence from mice and humans," Nature Reviews Cancer, Jan. 2010, 10(1):51-57.
Conarello et al., "Mice lacking dipeptidyl peptidase IV are protected against obesity and insulin resistance," Proc. Natl. Acad. Sci. U.S.A., May 27, 2003, 100(11):6825-6830.
Conlon et al., "Abstract CT082: Phase (Ph) I/Ib study of NIZ985 with and without spartalizumab (PDR001) in patients (pts) with metastatic/unresectable solid tumors," Cancer Res. 79(13 Suppl.):CT082, Jul. 1, 2019, 2 pages.
Coppe et al., "Tumor Suppressor and Aging Biomarker p16INK4a Induces Cellular Senescence without the Associated Inflammatory Secretory Phenotype," Journal of Biological Chemistry, Oct. 21, 2011, 286(42): 36396-36403.
Cosman et al., "ULBPs, novel MHC class I-related molecules, bind to CMV glycoprotein UL16 and stimulate NK cytotoxicity through the NKG2D receptor," Immunity, Feb. 1, 2001, 14(2):123-33.
Costa et al., "Targeting the epidermal growth factor receptor can counteract the inhibition of natural killer cell function exerted by colorectal tumor-associated fibroblasts," Frontiers in Immunology, May 29, 2018, 9:1150, 14 pages.
Crews et al., "Molecular mechanisms of neurodegeneration in Alzheimer's disease," Human Molecular Genetics, Apr. 22, 2010, 19(R1):R12-R20, 9 pages.
Cromie et al., "Nanobodies and their use in GPCR drug discovery," Current Topics in Medicinal Chemistry, Dec. 1, 2015, 15(24):2543-57.
Czaja et al., "A comprehensive analysis of the binding of anti-KIR antibodies to activating KIRs," Genes and Immunity, Jan. 2014, 15(1), 15 pages.
Da Silva et al., "Dipeptidylpeptidase 4 inhibition enhances lymphocyte trafficking, improving both naturally occurring tumor immunity and immunotherapy," Nature Immunology, Jun. 15, 2015, 16(8):850-858, 11 pages.
Dall'Era et al., "Adoptive Regulatory T Cell Therapy in a Patient with Systemic Lupus Erythematosus," Arthritis Rheumatology, Mar. 2019, 71(3):431-440.
De Crescenzo et al., "Engineering TGF-β Traps: Artificially Dimerized Receptor Ectodomains as High-affinity Blockers of TGF-β Action," Transforming Growth Factor-β in Cancer Therapy, vol. II, 2008, Humana Press, 671-84.
De Genst et al., "Antibody repertoire development in camelids," Developmental & Comparative Immunology, Jan. 1, 2006, 30(1-2):187-98.
De Meyer et al., "Nanobody-based products as research and diagnostic tools," Trends in Biotechnology, May 1, 2014, 32(5):263-70.
De Stefano et al., "Establishing pathological cut-offs of brain atrophy rates in multiple sclerosis," Journal of Neurology, Neurosurgery, and Psychiatry, Jan. 2016, 87(1):93-99.
Deacon, "Physiology and Pharmacology of DPP-4 in Glucose Homeostasis and the Treatment of Type 2 Diabetes," Frontiers in Endocrinology, Feb. 2019, 10:80, 14 pages.
Deaglio et al., "Adenosine generation catalyzed by CD39 and CD73 expressed on regulatory T cells mediates immune suppression," Journal of Experimental Medicine, May 14, 2007, 204(6):1257-1265.
Demaria et al., "An Essential Role for Senescent Cellsin Optimal Wound Healing through Secretion of PDGF-AA," Developmental Cell, Dec. 22, 2014, 31(6):722-733.
Deyev et al., "Design of multivalent complexes using the barnase-barstar module," Nature Biotechnology, Dec. 2003, 21(12):1486-92.
Di Ianni et al., "Tregs prevent GVHD and promote immune reconstitution inHLA-haploidentical transplantation," Blood, Apr. 7, 2011, 117(14):3921-3928.
Dietel et al., "Decreased Nos. of regulatory T cells are associated with human atherosclerotic lesion vulnerability and inversely correlate with infiltrated mature dendritic cells," Atherosclerosis, Sep. 2013, 230:92-99.

DiGiammarino et al., "Design and generation of DVD-Ig™ molecules for dual-specific targeting," Therapeutic Proteins: Methods and Protocols, Methods in Molecular Biology, 2012, Humana Press, Totowa, NJ., 899:145-516.
Dikov et al., "New fluorescent method for the histochemical detection of tripeptidyl peptidase I using glycyl-1-proly1-1-met-2-anthraquinonyl hydrazide as substrate," Cellular and Molecular Biology, Jan. 1, 2004, 50 Online Pub: OL565-568, 1 page (Abstract Only).
Dimri et al., "A biomarker that identifies senescent human cells in culture and in aging skin in vivo," Proceedings of the National Academy of Sciences, Sep. 29, 1995, 92(20):9363-9367.
Dinarello, "Interleukin 1 and interleukin 18 as mediators of inflammation and the aging process," The American Journal of Clinical Nutrition, Feb. 1, 2006, 83(2):447S-455S.
Docagne et al., "A soluble transforming growth factor-β (TGF-β) type I receptor mimics TGF-β responses," Journal of Biological Chemistry, Dec. 7, 2001, 276(49):46243-50.
Dong et al., "Characterization of adenosine deaminase binding to human CD26 on T cells and its biologic role in immune response," Journal of Immunology, Feb. 15, 1996, 156(4):1349-1355.
Dong et al., "Determination of adenosine deaminase binding domain on CD26 and its immunoregulatory effect on T cell activation," Journal of Immunology, Dec. 15, 1997, 159(12):6070-6076.
Dong et al., "Loss of methylation at the IFNG promoter and CNS-1 is associated with the development of functional IFN-γ memory in human CD4+T lymphocytes," European Journal of Immunology, 2013, 43(3), 793-804.
Dou et al., "Cytoplasmic chromatin triggers inflammation in senescence and cancer," Nature, Oct. 4, 2017, 550(7676):402-406, 21 pages.
Drees, et al., "Soluble production of a biologically active single-chain antibody against murine PD-L1 in *Escherichia coli*," Protein Express. Purif., 2014, 94:60-66.
Dubois et al., "Preassociation of IL-15 with IL-15Rα-IgG1-Fc Enhances Its Activity on Proliferation of NK and CD8+/CD44high T Cells and Its Antitumor Action," The Journal of Immunology, Feb. 15, 2008, 180:2099-2106.
Edwardraja et al., "Redesigning of anti-c-met single chain Fv antibody for the cytoplasmic folding and its structural analysis," Biotechnology and Bioengineering, Jun. 15, 2010, 106(3):367-75.
Eisenhut et al., "Ion Channels in Inflammation," Pflugers Archive, Jan. 29, 2011, 461(4):401-421.
Elgueta et al., "Molecular mechanism and function of CD40/CD40L engagement in the immune system," Immunological Reviews, 2009, 229(1):152-172 doi.org/10.1111/j.1600-065X.2009.00782.x.
Elpek et al., "Mature natural killer cells with phenotypic and functional alterations accumulate upon sustained stimulation with IL-15/IL-15Rα complexes," Proceedings of the National Academy of Science, Dec. 14, 2010, 107: 21647-21652.
Engel et al., "The crystal structure of dipeptidyl peptidase IV (CD26) reveals its functional regulation and enzymatic mechanism," Proc. Natl. Acad. Sci. U.S.A., Apr. 29, 2003, 100(9):5063-5068.
Epardaud et al., "Interleukin-15/Interleukin-15RA Complexes Promote Destruction of Established Tumors by Reviving Tumor-Resident CD8+ T Cells," Cancer Research 68: Apr. 15, 2008, 2972-2983.
Esensten et al., "Regulatory T-cell therapy for autoimmune and autoinflammatory diseases: The next frontier," The Journal of Allergy and Clinical Immunology, Dec. 1, 2018, 142(6):1710-1718.
Farr, et al., "Targeting cellular senescence prevents age-related bone loss in mice," Nat. Med., 2017, 23(9): 1072-1079.
Fehniger et al., "A Phase 1 Trial of CNDO-109-Activated Natural Killer Cells in Patients with High-Risk Acute Myeloid Leukemia," Biology of Blood and Marrow Transplantation, Aug. 2018, 24(8):1581-1589.
Feng et al., "The yin and yang functions of extracellular ATP and adenosine in tumor immunity," Cancer Cell International, Apr. 7, 2020, 20:110, 11 pages.
Ferreira et al., "Next-generation regulatory T cell therapy," Nature Reviews Drug Discovery, Sep. 20, 2019, 18(10):749-769, 21 pages.

(56) References Cited

OTHER PUBLICATIONS

Ferrucci et al., "The origins of age-related proinflammatory state," Blood, Mar. 15, 2005, 105(6):2294-2299.
Finkelman et al., "Anti-cytokine antibodies as carrier proteins. Prolongation of in vivo effects of exogenous cytokines by injection of cytokine-anti-cytokine antibody complexes," The Journal of Immunology, Aug. 1, 1993, 151:1235-1244.
Finkelstein et al., "Obesity and Severe Obesity Forecasts Through 2030," American Journal of Preventative Medicine, Jun. 2012, 42(6):563-570.
Ford et al., "TREM and TREM-like receptors in inflammation and disease," Current Opinion in Immunology, Feb. 21, 2009, 21(1):38-46.
Franceschi et al., "Inflamm-aging. An evolutionary perspective on immunosenescence," Annals of the New York Academy of Sciences, Jun. 2000, 908:244-254.
Frutoso et al., "Emergence of NK Cell Hyporesponsiveness after Two IL-15 Stimulation Cycles," Journal of Immunology, May 30, 2018, 201: 493-506.
Ganesh et al., "TGF-β Inhibition and Immunotherapy: Checkmate," Immunity, Apr. 17, 2018, 48(4):626-628.
Garber, "Bispecific antibodies rise again," Nat. Rev. Drug Discov., 2014, 13:799-801.
Gaulton et al., "Characterization of a monoclonal rat anti-mouse interleukin 2 (IL-2) receptor antibody and its use in the biochemical characterization of the murine IL-2 receptor," Clinical Immunology and Immunopathology, Jul. 1, 1985, 36(1):18-29.
Gejima et al., "Human single-chain Fv (scFv) antibody specific to human IL-6 with the inhibitory activity on IL-6-signaling," Human Antibodies, Jan. 1, 2002, 11(4):121-9.
Geng et al., "A novel anti-TNF scFv constructed with human antibody frameworks and antagonistic peptides," Immunol. Res. 62(3):377-385, 2015.
Georgilis et al., "PTBP1-Mediated Alternative Splicing Regulates the Inflammatory Secretome and the Pro-tumorigenic Effects of Senescent Cells," Cancer Cell, Jul. 9, 2018, 34(1):85-102.
Ghosh et al., "The Senescence-Associated Secretory Phenotype: Critical Effector in Skin Cancer and Aging," Journal of Investigative Dermatology, Nov. 2016, 136(11):2133-2139.
Gibbs et al., "Identification of the factor VIIa binding site on tissue factor by homologous loop swap and alanine scanning mutagenesis," Biochemistry, Nov. 1, 1994, 33(47):14003-10.
Gong et al., "DAMP-sensing receptors in sterile inflammation and inflammatory diseases," Nature Reviews Immunology, Sep. 26, 2019, 20(2):95-112.
Gorrell et al., "Expression of the rat CD26 Antigen (dipeptidyl peptidase IV) on subpopulations of rat lymphocytes," Cellular Immunology, Apr. 15, 1991, 134(1):205-215.
Greenspan et al., "Defining epitopes: Its not as easy as it seems," Nature Biotechnology, 1999, 17:936-937.
Grupp et al., "Chimeric Antigen Receptor-Modified T Cells for Acute Lymphoid Leukemia," The New England Journal of Medicine, Apr. 18, 2013, 368(16):1509-1518.
Gu et al., "Human CD39hi regulatory T cells present stronger stability and function under inflammatory conditions," Cellular and Molecular Immunology, Jul. 4, 2016, 14(6):521-528.
Guo et al., "Immunobiology of the IL-15-IL-15R complex as an antitumor and antiviral agent," 2017, Cytokine & Growth Factor Reviews, 38:10-21.
Gutschmidt et al., "A quantitative histochemical study of dipeptidyl peptidase IV (DPP IV)," Histochemistry, 1981, 73(2):285-304.
Haile et al., "Soluble CD80 Restores T Cell Activation and Overcomes Tumor Cell Programmed Death Ligand 1-Mediated Immune Suppression," J. Immunol., 2013, 191(5):2829-2836.
Hayflick et al., "The serial cultivation of human diploid cell strains," Experimental Cell Research, Dec. 1961, 25:585-621.
He et al., "Senescence in Health and Disease," Cell, Jun. 1, 2017, 169(6):1000-1011.

Hebbar et al., "Detection of circulating soluble CD28 in patients with systemic lupus erythematosus, primary Sjögren's syndrome and systemic sclerosis," Clinical & Experimental Immunology, May 2004, 136(2):388-92.
Helfrich et al., "A rapid and versatile method for harnessing scFv antibody fragments with various biological effector functions," Journal of Immunological methods, 2000, 237(1-2):131-145 DOI:IO. IO16/S0022-1759(99)OO220-3.
Heneka et al., "Inflammasome signaling in brain function and neurodegenerative disease," Nature Reviews Neuroscience, Sep. 11, 2018, 19(10):610-621.
Heneka et al., "NLRP3 is activated in Alzheimer's disease and contributes to pathology in APP/PS1 mice," Nature, Jan. 31, 2013, 493(7434):674-678, 8 pages.
Heng et al., "G Protein-Coupled Receptors Revisited: Therapeutic Applications Inspired by Synthetic Biology," Annual Review of Pharmacology and Toxicology, Jan. 2014, 54:227-249.
Heng et al., Sophea, et al. "Multiple soluble TGF-β receptors in addition to soluble endoglin are elevated in preeclamptic serum and they synergistically inhibit TGF-β signaling." Placenta, 2017 57:320 (1 page).
Highfill et al., "Overcoming Challenges in Process Development of Cellular Therapies," Current Hematologic Malignancy Reports, Jul. 6, 2019, 14(4):269-277, 9 pages.
Hoare et al., "The Power Behind the Throne: Senescence and the Hallmarks of Cancer," Annual Review of Cancer Biology, 2018, 2:175-194.
Hoffmann et al., "Large-scale in vitro expansion of polyclonal human CD4+CD25high regulatory T Cells," Blood, Aug. 2004, 104(3):895-903.
Hollande et al., "Inhibition of the dipeptidyl peptidase DPP4 (CD26) reveals IL-33-dependent eosinophil-mediated control of tumor growth," Nature Immunology, Feb. 18, 2019, 20(3):257-264.
Hombach et al., "Generation of the single chain antibody fragment conserves the idiotypic profile of the anti-CD30 monoclonal antibody HRS3," Scandinavian Journal of Immunology, Nov. 1998, 48(5):497-501.
Hu et al., "Discovery of a novel IL-15 based protein with improved developability and efficacy for cancer immunotherapy," Scientific Reports, 2018, 8:7675, 11 pages.
Huang et al., "Substrate recognition by tissue factor-factor VIIa Evidence for interaction of residues Lys165 and Lys166 of tissue factor with the 4-carboxyglutamate-rich domain of factor X," Journal of Biological Chemistry, Sep. 6, 1996, 271(36):21752-7.
Hudak et al., "Glycocalyx engineering reveals a Siglec-based mechanism for NK cell immunoevasion," Nature Chemical Biology, Jan. 2014, 10(1), 20 pages.
Hudson et al., "Targeting RAGE Signaling in Inflammatory Disease," Annual Review of Medicine, Jan. 2018, 69:349-364, 16 pages.
Huell et al., "Interleukin-6 is present in early stages of plaque formation and is restricted to the brains of Alzheimer's disease patients," Acta Neuropathologica, Nov. 1995, 89(6):544-551.
Hughes, et al., "Transfer of a TCR gene derived from a patient with a marked antitumor response conveys highly active T-cell effector functions," Hum. Gene Ther., 2005, 16:457-72.
Hynes et al., "In vitro analysis of cell metabolism using a long-decay pH-sensitive lanthanide probe and extracellular acidification assay," Analytical biochemistry, Jul. 1, 2009, 390(1):21-28.
Iannello et al., "p53-dependent chemokine production by senescent tumor cells supports NKG2D-dependent tumor elimination by natural killer cells," Journal of Experimental Medicine, Sep. 23, 2013, 210(10):2057-69.
Iihoshi et al., "Aclarubicin, an anthracycline anti-cancer drug, fluorescently contrasts mitochondria and reduces the oxygen consumption rate in living human cells," Toxicology Letters, Aug. 5, 2017, 277:109-114, 22 pages.
Inzucchi et al., "New Drugs for the Treatment of Diabetes, Part II: Incretin-Based Therapy and Beyond," Circulation, Jan. 29, 2008, 117(4):574-584, 21 pages.
Jain et al., "Mitochondrial Reactive Oxygen Species Regulate Transforming Growth Factor-β Signaling," Journal of Biological Chemistry, Jan. 11, 2013, 288(2):770-777.

(56) References Cited

OTHER PUBLICATIONS

Jakob et al., "Structure reveals function of the dual variable domain immunoglobulin (DVD-Ig™) molecule," Mabs, May 1, 2013, Taylor & Francis, 5(3):358-63.
Janeway, "Approaching the Asymptote? Evolution and Revolution in Immunology," Cold Spring Harbor Symposia on Quantitative Biology, 1989, 54 Pt 1:1-13.
Jeannin et al., "Soluble CD86 Is a Costimulatory Moleculefor Human T Lymphocytes," Immunity, 2000, 13(3):303-312.
Jin et al., "Novel Insights Into the NLRP3 Inflammasome in Atherosclerosis," Journal of the American Heart Association, Jun. 11, 2019, 8(12):e012219, 12 pages.
Justice et al., "Senolytics in idiopathic pulmonary fibrosis: Results from a first-in-human, open-label, pilot study," EBioMedicine, Feb. 2019, 40:554-563.
Kain et al., "The identification of the endogenous ligands of natural killer T cells reveals the presence of mammalian α-linked glycosylceramides," Immunity, Oct. 16, 2014, 41(4):543-54.
Karin et al., "Senescent cell turnover slows with age providing an explanation for the Gompertz law," Nature Communications, 10:5495, 9 pages, (2019).
Karkera et al., "The anti-interleukin-6 antibody siltuximab downregulates genes implicated in tumorigenesis in prostate cancer patients from a phase I study," The Prostate, Feb. 14, 2011, 71(13):1455-1465.
Katsuumi et al., "Vascular Senescence in Cardiovascular and Metabolic Diseases," Frontiers in Cardiovascular Medicine, 5:18, 13 pages, (2018).
Kellner et al., "Enhancing natural killer cell-mediated lysis of lymphoma cells by combining therapeutic antibodies with CD20-specific immunoligands engaging NKG2D or NKp30," Oncoimmunology, Jan. 2, 2016, 5(1):e1058459, 12 pages.
Kijanka et al., "Nanobody-based cancer therapy of solid tumors," Nanomedicine, Jan. 2015, 10(1):161-74.
Kim et al., "Experimental malaria infection triggers early expansion of natural killer cells," Infection and Immunity, Dec. 1, 2008, 76(12):5873-82.
Kim et al., "Identification of senescent cell surface targetable protein DPP4," Genes & Development, 2017, 31(15):1529-1534.
Kim et al., "SCAMP4 enhances the senescent cell secretome," Genes & Development, 2018, 32(13-14):909-914.
Kirchhofer et al., "The tissue factor region that interacts with substrates factor IX and factor X," Biochemistry, Jun. 27, 2000, 39(25):7380-7.
Kirkland et al., "Cellular Senescence: A Translational Perspective," EBioMedicine, Jul. 2017, 21:21-28.
Klein et al., "Cergutuzumab amunaleukin (CEA-IL2v), a CEA-targeted IL-2 variant-based immunocytokine for combination cancer immunotherapy: Overcoming limitations of aldesleukin and conventional IL-2-based immunocytokines," Oncoimmunology, 2017 6(3):e1277306, 15 pages.
Klein et al., "Design and characterization of structured protein linkers with differing flexibilities," Protein Engineering, Design & Selection, 2014, 27(10):325-30.
Klemann et al., "Cut to the chase: a review of CD26/dipeptidyl peptidase-4's (DPP4) entanglement in the immune system," Clinical and Experimental Immunology, Feb. 25, 2016, 185(1):1-21.
Klingenberg et al., "Depletion of FOXP3+ regulatory T cells promotes hypercholesterolemia and atherosclerosis," The Journal of Clinical Investigation, Feb. 15, 2013, 123:1323-1334.
Kondo et al., "Requirements for the functional expression of OX40 ligand on human activated CD4+ and CD8+ T cells," Human Immunology, 2007, 68(7):563-571.
Kovaleva et al., "Shark variable new antigen receptor biologics—a novel technology platform for therapeutic drug development," Expert Opinion on Biological Therapy, Oct. 1, 2014, 14(10):1527-39.
Krah et al., "Single-domain antibodies for biomedical applications," Immunopharmacology and Immunotoxicology, Jan. 2, 2016, 38(1):21-8.
Kritsilis et al., "Ageing, Cellular Senescence and Neurodegenerative Disease," International Journal of Molecular Sciences, Sep. 27, 2018, 19(10):2937, 37 pages.
Krizhanovsky et al., "Senescence of activated stellate cells limits liver fibrosis," Cell, Aug. 22, 2008, 134(4):657-67.
Kumagai et al., "Monitoring of glutamate-induced excitotoxicity by mitochondrial oxygen consumption," Synapse, Jan. 2019, 73(1):e22067, 24 Pages.
Lambeir et al., "Dipeptidyl-Peptidase IV from Bench to Bedside: An Update on Structural Properties, Functions, and Clinical Aspects of the Enzyme DPP IV," Critical Reviews in Clinical Laboratory Sciences, Sep. 29, 2003, 40(3):209-294.
Lamkanfi et al., "Mechanisms and Functions of Inflammasomes," Cell, May 22, 2014, 157(5):1013-1022.
Lansigan et al., "DI-Leu16-IL2, an Anti-CD20-Interleukin-2 Immunocytokine, Is Safe and Active in Patients with Relapsed and Refractory B-Cell Lymphoma: A Report of Maximum Tolerated Dose, Optimal Biologic Dose, and Recommended Phase 2 Dose," Blood, Dec. 2, 2016, 128(22):620, 3 pages (Abstract Only).
Latz et al., "Activation and regulation of the inflammasomes," Nature Reviews Immunology, May 24, 2013, 13(6):397-411.
Latz et al., "NLRP3 inflammasome activation in inflammaging," Seminars in Immunology, Dec. 2018, 40:61-73, 13 pages.
Lau et al., "RNA-associated autoantigens activate B cells by combined B cell antigen receptor/Toll-like receptor 7 engagement," The Journal of Experimental Medicine, Oct. 31, 2005, 202(9):1171-1177.
Lazar et al., "Transforming Growth Factor Alpha: Mutation of Aspartic Acid 47 and Leucine 48 Results in Different Biological Activities," Mol. Cell. Biol., 1988, 8:1247-1252.
Li et al., "A Novel IL2-based Irrmunotherapeutic Protein Prevents the Development of Atherosclerosis in ApoE-/mice and LDLR-/-mice," Journal of Immunology, May 1, 2020, 204(1):Supplement (Abstract Only), 2 pages.
Li et al., "Adoptive transfer of natural killer cells in combination with chemotherapy improves outcomes of patients with locally advanced colon carcinoma," Cytotherapy, Jan. 2018, 20(1):134-148, 15 pages.
Li et al., "The cGAS-cGAMP-STING pathway connects DNA damage to inflammation, senescence, and cancer," Journal of Experimental Medicine, Apr. 5, 2018, 215(5):1287-1299.
Liton et al., "Cellular senescence in the glaucomatous outflow pathway," Experimental Gerontology, Aug.-Sep. 2005, 40(8-9):745-748.
Liu et al., "A Novel Fusion of ALT-803 (IL-15 Superagonist) with an Antibody Demonstrates Antigen-specific Antitumor Responses," Journal of Biological Chemistry, 2016, 291(46):23869-23881.
Liu et al., "Evaluation of the biological activities of the IL-15 superagonist complex, ALT-803, following intravenous versus subcutaneous administration in murine models," Cytokine, Jul. 2018, 107: 105-112, 8 pages.
Loster et al., "The Cysteine-Rich Region of Dipeptidyl Peptidase IV (CD 26) Is the Collagen Binding Site," Biochemical and Biophysical Research Communications, Dec. 5, 1995, 217(1):341-348.
Lu et al., "Molecular basis of binding between novel human coronavirus MERS-CoV and its receptor CD26," Nature, Jul. 7, 2013, 500(7461):227-231.
Lujambio et al., "Non-Cell-Autonomous Tumor Suppression by p53," Cell, Apr. 11, 2013, 153(2):449-460.
Maeda et al., "Original Ligand for LTβR Is LIGHT: Insight into Evolution of the LT/LTβR System," J Immunol., 2018, 201(1):202-214.
Maganto-García et al., "Dynamic Changes in Regulatory T Cells Are Linked to Levels of Diet-Induced Hypercholesterolemia," Circulation, Jun. 20, 2011, 124:185-195.
Mandelboim et al., "Recognition of haemagglutinins on virus-infected cells by NKp46 activates lysis by human NK cells," Nature, Feb. 2001, 409(6823):1055.
Marguet et al., "Enhanced insulin secretion and improved glucose tolerance in mice lacking CD26," Proc. Natl. Acad. Sci. U.S.A., Jun. 6, 2000, 97(12):6874-6879.

(56) References Cited

OTHER PUBLICATIONS

Martelli et al., "HLA-haploidentical transplantation with regulatory and conventional T-cell adoptive immunotherapy prevents acute leukemia relapse," Blood, Jul. 24, 2014, 124(4):638-644.
Masoumi et al., "The role of hypoxia as the driving force for non-erythroid production of globin chains in preeclamptic placentas," Placenta. 2017;57:320.
Mchugh et al., "Senescence and aging: Causes, consequences, and therapeutic avenues," Journal of Cellular Biology, Nov. 7, 2017, 217(1):65-77.
Mehta et al., "Why do trials for Alzheimer's disease drugs keep failing? A discontinued drug perspective for 2010-2015," Expert Opinion on Investigational Drugs, May 2017, 26(6):735-739.
Menshawy et al., "CD58; leucocyte function adhesion-3 (LFA-3) could be used as a differentiating marker between immune and non-immune thyroid disorders," Comparative Clinical Pathology, 2018, 27(3), 721-727, doi.org/10.1007/s00580-018-2657-x.
Mentlein et al., "Dipeptidyl-peptidase IV (CD26)-role in the inactivation of regulatory peptides," Regulatory Peptides, Nov. 30, 1999, 85(1):9-24.
Miah et al., "KIR2DL4 differentially signals downstream functions in human NK cells through distinct structural modules," The Journal of Immunology, Mar. 1, 2008, 180(5):2922-32.
Michelet et al., "Metabolic reprogramming of natural killer cells in obesity limits antitumor responses," Nature Immunology, Nov. 12, 2018, 19(12):1330-1340.
Milanovic et al., "Senescence-associated reprogramming promotes cancer stemness," Nature, Dec. 20, 2017, 553(7686):96-100.
Milanovic et al., "The Senescence-Stemness Alliance—A Cancer-Hijacked Regeneration Principle," Trends in Cellular Biology, Dec. 2018, 28(12):1049-1061, 13 pages.
Miller et al., "Soluble CD70: a novel immunotherapeutic agent for experimental glioblastoma," J Neurosurg., 2010, 113(2):280-285.
Miller et al., "Successful adoptive transfer and in vivo expansion of human haploidentical NK cells in patients with cancer," Blood, Apr. 15, 2005, 105(8):3051-3057.
Minamino et al., "A crucial role for adipose tissue p53 in the regulation of insulin resistance," Nature Medicine, Aug. 30, 2009, 15(9):1082-1087.
Mitterberger et al., "Adipogenic Differentiation Is Impaired in Replicative Senescent Human Subcutaneous Adipose-Derived Stromal/Progenitor Cells," The Journals of Gerontology: Series A, Biological Sciences and Medical Sciences, Jan. 2014, 69(1):13-24.
Miyazaki et al., "Abstract 3265: NKTR-255, a polymer-conjugated IL-15 enhances anti-tumor NK cell responses and synergizes with monoclonal antibodies to provide long-term survival in human lymphoma model," Proceedings: AACR Annual Meeting 2019, Atlanta, GA, Mar. 29-Apr. 3, 2019, 1 page.
Moesta et al., "Targeting CD39 in cancer," Nature Reviews Immunology, Jul. 29, 2020, 20(12):739-755, 17 pages.
Moiseeva et al., "Metformin inhibits the senescence-associated secretory phenotype by interfering with IKK/NF-κB activation," Aging Cell, Mar. 23, 2013, 12(3):489-498.
Molema et al., "The use of bispecific antibodies in tumor cell and tumor vasculature directed immunotherapy," Journal of Controlled Release, 2000, 64(1-3):229-239.
Molgora et al., "Regulatory role of IL-1R8 in immunity and disease," Frontiers in Immunology, Apr. 20, 2016, 7:149.
Mookerjee et al., "Measurement and Analysis of Extracellular Acid Production to Determine Glycolytic Rate," Journal of Visualized Experiments : Jove, Dec. 2015, (106):e53464, 9 Pages.
Moore et al., "Macrophages in atherosclerosis: a dynamic balance," Nature Reviews Immunology, Sep. 2, 2013, 13:709-721, 13 pages.
Moreno et al., "Molecular Evidence of Adenosine Deaminase Linking Adenosine A2A Receptor and CD26 Proteins," Frontiers in Pharmacology, Feb. 15, 2018, 9:106, 18 pages.
Moretta et al., "CD69-mediated pathway of lymphocyte activation: anti-CD69 monoclonal antibodies trigger the cytolytic activity of different lymphoid effector cells with the exception of cytolytic T lymphocytes expressing T cell receptor alpha/beta," Journal of Experimental Medicine, Dec. 1, 1991, 174(6):1393-8.
Mujić-Delić et al., "GPCR-targeting nanobodies: attractive research tools, diagnostics, and therapeutics," Trends in Pharmacological Sciences, May 1, 2014, 35(5):247-55.
Muller et al., "Antibody fusions with immunomodulatory proteins for cancer therapy," Pharmacology and Therapeutics, 2015, 154:57-66.
Mulvihill et al., "Pharmacology, Physiology, and Mechanisms of Action of Dipeptidyl Peptidase-4 Inhibitors," Endocrine Reviews, Dec. 1, 2014, 35(6):992-1019.
Munoz-Espin et al., "Cellular senescence: from physiology to pathology," Nature Reviews Molecular Cellular Biology, Jun. 23, 2014, 15(7):482-496.
Munoz-Espin et al., "Programmed Cell Senescence during Mammalian Embryonic Development," Cell, Nov. 21, 2013, 155(5):1104-1118.
Musi et al., "Tau protein aggregation is associated with cellular senescence in the brain," Aging Cell, Aug. 20, 2018, 17(6):e12840, 13 pages.
Must et al., "The Disease Burden Associated with Overweight and Obesity," Endotext, Feingold et al. (eds.), South Dartmouth, MA, 2000, 35 pages.
Muyldermans et al., "Recognition of antigens by single-domain antibody fragments: the superfluous luxury of paired domains," Trends in Biochemical Sciences, Apr. 1, 2001, 26(4):230-5.
Muyldermans, "Nanobodies: natural single-domain antibodies," Annual Review of Biochemistry, Jun. 2, 2013, 82:775-97.
Muyldermans, "Single domain camel antibodies: current status," Reviews in Molecular Biotechnology, Jun. 1, 2001, 74(4):277-302.
Myung et al., "Evidence of DNA damage in Alzheimer disease: phosphorylation of histone H2AX in astrocytes," Age, Apr. 23, 2008, 30(4):209-215.
Nag et al., "Soluble MHC II-peptide complexes induce antigen-specific apoptosis in T cells," Cellular Immunology, May 25, 1996, 170(1):25-33.
Nayyar et al., "Overcoming Resistance to Natural Killer Cell Based Immunotherapies for Solid Tumors," Frontiers in Oncology, 2019, 9: DOI:10.3389/fonc.2019.00051.
Nelson et al., "A senescent cell bystander effect: senescence-induced senescence," Aging Cell, Feb. 9, 2012, 11(2):345-349.
Nilsson et al., "Targeted delivery of tissue factor to the ED-B domain of fibronectin, a marker of angiogenesis, mediates the infarction of solid tumors in mice," Cancer Research, American Association for Cancer Researc, Proceddings: AACR 107th Annual Meeting, 2016, Apr. 16-20, 2016, New Orleans, LA 61(2):711-716.
Nishida et al., "CD26 is a potential therapeutic target by humanized monoclonal antibody for the treatment of multiple myeloma," Blood Cancer Journal, Oct. 22, 2018, 8(11):99, 17 pages.
O'Sullivan et al., "Natural Killer Cell Memory," Immunity, Oct. 20, 2015, 43(4):634-645.
Oberle et al., "Rapid Suppression of Cytokine Transcription in Human CD4+CD25-T Cells by CD4+Foxp3+ Regulatory T Cells: Independence of IL-2 Consumption, TGF-β, and Various Inhibitors of TCR Signaling," The Journal of Immunology, Sep. 15, 2007, 179(6):3578-3587.
Ogrodnik et al., "Cellular senescence drives age-dependent hepatic steatosis," Nat Commun. Jun. 13, 2017;8:15691, 12 pages.
Ogrodnik et al., "Obesity-Induced Cellular Senescence Drives Anxiety and Impairs Neurogenesis," Cell Metabolism, May 2019, 29(5):1061-1077, 25 pages.
Ohnuma et al., "Blockade of CD26-mediated T cell costimulation with soluble caveolin-1-Ig fusion protein induces anergy in CD4+T cells," Biochemical and Biophysics Research Communications, Aug. 21, 2009, 386(2):327-332.
Ohnuma et al., "CD26 Mediates Dissociation of Tollip and IRAK-1 from Caveolin-1 and Induces Upregulation of CD86 on Antigen-Presenting Cells," Molecular and Cellular Biology, Sep. 1, 2005, 25(17):7743-7757.
Ohnuma et al., "CD26 up-regulates expression of CD86 on antigen-presenting cells by means of caveolin-1," Proc. Natl. Acad. Sci. U.S.A., Sep. 28, 2004, 101(39):14186-14191.

(56) References Cited

OTHER PUBLICATIONS

Ohnuma et al., "Role of CD26/dipeptidyl peptidase IV in human T cell activation and function," Frontiers in Bioscience, Jan. 1, 2008, 13:2299-2310.
Ohnuma et al., "Soluble CD26/Dipeptidyl Peptidase IV Induces T Cell Proliferation Through CD86 Up-Regulation on APCs," Journal of Immunology, Dec. 15, 2001, 167(12):6745-6755.
Ovadya et al., "Strategies targeting cellular senescence," The Journal of Clinical Investigation, Apr. 2, 2018, 128(4):1247-54.
Owicki et al., "Biosensors based on the energy metabolism of living cells: the physical chemistry and cell biology of extracellular acidification," Biosensors and Bioelectronics, Jan. 1, 1992, 7(4):255-272.
Padutsch et al., "Superior Treg-Expanding Properties of a Novel Dual-Acting Cytokine Fusion Protein," Frontiers in Pharmacology, Dec. 18, 2019, 10:1490, 10 pages.
Palmer et al., "Cellular Senescence in Type 2 Diabetes: A Therapeutic Opportunity," Diabetes, Jul. 2015, 64(7):2289-2298.
Parker et al., "Design, production, and characterization of a single-chain variable fragment (ScFv) derived from the prostate specific membrane antigen (PSMA) monoclonal antibody J591," Protein Expression and Purification, Jun. 1, 2013, 89(2):136-45.
PCT International Preliminary Report on Patentability in International Appln. No. PCT/US2019/048881, dated Mar. 11, 2021, 7 pages.
PCT International Preliminary Report on Patentability in International Appln. No. PCT/US2019/048930, dated Mar. 11, 2021, 9 pages.
PCT International Preliminary Report on Patentability in International Appln. No. PCT/US2019/049142, dated Mar. 11, 2021, 11 pages.
PCT International Preliminary Report on Patentability in International Appln. No. PCT/US2019/049158, dated Mar. 11, 2021, 8 pages.
PCT International Search Report and Written Opinion in International Appln. No. PCT/US2019/048881, dated Nov. 9, 2019, 16 pages.
PCT International Search Report and Written Opinion in International Appln. No. PCT/US2019/048930, dated Nov. 20, 2019, 18 pages.
PCT International Search Report and Written Opinion in International Appln. No. PCT/US2019/04912, dated Jun. 23, 2020, 20 pages.
PCT International Search Report and Written Opinion in International Appln. No. PCT/US2019/049158, dated Jan. 20, 2020, 18 pages.
PCT International Search Report and Written Opinion in International Appln. No. PCT/US2020/035598, dated Feb. 18, 2021, 12 pages.
PCT International Search Report and Written Opinion in International Appln. No. PCT/US2020/038717, dated Oct. 16, 2020, 17 pages.
PCT International Search Report and Written Opinion in International Appln. No. PCT/US2021/017620, dated Aug. 6, 2021, 22 pages.
PCT International Search Report and Written Opinion in International Appln. No. PCT/US2021/017621, dated Jun. 9, 2021, 15 pages.
PCT International Search Report and Written Opinion in International Appln. No. PCT/US2021/017714, dated Aug. 27, 2021, 22 pages.
Peipp et al., "HER2-specific immunoligands engaging NKp30 or NKp80 trigger NK-cell-mediated lysis of tumor cells and enhance antibody-dependent cell-mediated cytotoxicity," Oncotarget, Oct. 13, 2015, 6(31):32075.
Pittayapruek et al., "Role of Matrix Metalloproteinases in Photoaging and Photocarcinogenesis," International Journal of Molecular Sciences, 2016, 17(6):868, 20 pages.
Priyanka et al., "Linkers in the structural biology of protein-protein interactions," Protein Sci., 2013, 22(2):153-167.
Purohit et al., "Smad3-dependent regulation of type I collagen in human dermal fibroblasts: Impact on human skin connective tissue aging," Journal of Dermatological Science, Jul. 2016, 83(1):80-83, 4 pages.
Qin et al., "Critical Role of P2Y12 Receptor in Regulation of Th17 Differentiation and Experimental Autoimmune Encephalomyelitis Pathogenesis," The Journal of Immunology, Jul. 1, 2017, 199(1):72-81.
Rafei et al., "Off-the-shelf virus specific T-cells for therapy of adenovirus disease in immunosuppressed patients," Journal of Clinical Oncology, May 26, 2019, 37(15 Suppl.):7008, 2 pages.
Rahbarizadeh et al., "Nanobody; an old concept and new vehicle for immunotargeting," Immunological Investigations, Jan. 1, 2011, 40(3):299-338.
Raj et al., "Adenosine Deaminase Acts as a Natural Antagonist for Dipeptidyl Peptidase 4-Mediated Entry of the Middle East Respiratory Syndrome Coronavirus," Journal of Virology, Feb. 2014, 88(3):1834-1838, 7 pages.
Ranganathan et al., "Pinpointing the putative heparin/sialic acid-binding residues in the 'sushi' domain 7 of factor H: a molecular modeling study," Biocomputing 2000, 1999, 155-67.
Rao et al., "Purification and characterization of rabbit tissue factor," Thrombosis Research, Oct. 1, 1989, 56(1):109-118.
Rasmussen et al., "Crystal structure of human dipeptidyl peptidase IV/CD26 in complex with a substrate analog," Nature Structural and Molecular Biology, 2003, 10(1):19-25.
Raz et al., "Efficacy and safety of the dipeptidyl peptidase-4 inhibitor sitagliptin as monotherapy in patients with type 2 diabetes mellitus," Diabetologia, Sep. 26, 2006, 49(11):2564-2571.
Resta et al., "Ecto-enzyme and signaling functions of lymphocyte CD 7 3," Immunological Reviews, 1998, 161:95-109.
Rhein et al., "Characterization of Human and Murine T-Cell Immunoglobulin Mucin Domain 4 (TIM-4) IgV Domain Residues Critical for Ebola Virus Entry," J Viral., 2016, 90(13):6097-6111.
Rippmann et al., "Fusion of the Tissue Factor Extracellular Domain to a Tumor Stromaspecific Single-Chain Fragment Variable Antibody Results in an Antigen-Specific Coagulation-Promoting Molecule," Biochemical Journal, 2000, 349(3):805-812.
Rittie et al., "Natural and Sun-Induced Aging of Human Skin," Cold Spring Harbor Perspective in Medicine, 2015, 5(1):a015370, 15 pages.
Rocha et al., "A novel immunofluorescent assay to investigate oxidative phosphorylation deficiency in mitochondrial myopathy: understanding mechanisms and improving diagnosis," Scientific reports, Oct. 15, 2015, 5:15037, 17 Pages.
Rodier et al., "Persistent DNA damage signaling triggers senescence-associated inflammatory cytokine secretion," Nature Cell Biology, Jul. 13, 2009, 11(8): 973-979, 15 pages.
Rogge et al., "Antibodies to the IL-12 receptor β2 chain mark human Th1 but not Th2 cells in vitro and in vivo," The Journal of Immunology, Apr. 1, 1999, 162(7):3926-32.
Roh et al., "Damage-Associated Molecular Patterns in Inflammatory Diseases," Immune Network, Aug. 2018, 18(4):e27, 14 pages.
Romano et al., "Past, Present, and Future of Regulatory T Cell Therapy in Transplantation and Autoimmunity," Frontiers in Immunology, Jan. 1, 2019, 10:43, 14 pages.
Romee et al., "Cytokine activation induces human memory-like NK cells," Blood, Dec. 6, 2012, 120(24):4751-4760.
Rossi et al., "Complex and defined biostructures with the dock-and-lock method," Trends in Pharmacological Sciences, Sep. 1, 2012, 33(9):474-81.
Rossi et al., "Stably tethered multifunctional structures of defined composition made by the dock and lock method for use in cancer targeting," Proceedings of the National Academy of Sciences, May 2, 2006, 103(18):6841-6.
Rubinstein et al., "Converting IL-15 to a superagonist by binding to soluble IL-15Rα," Proceedings of the National Academy of Sciences U.S.A., Jun. 13, 2006, 103(24):9166-9171.
Ruf et al., "Cofactor residues lysine 165 and 166 are critical for protein substrate recognition by the tissue factor-factor VIIa protease complex," Journal of Biological Chemistry, Mar. 25, 1992, 267(9):6375-81.

(56) References Cited

OTHER PUBLICATIONS

Ruf et al., "Tissue factor residues 157-167 are required for efficient proteolytic activation of factor X and factor VII," Journal of Biological Chemistry, Nov. 5, 1992, 267(31):22206-10.
Ruscetti et al., "NK cell-mediated cytotoxicity contributes to tumor control by a cytostatic drug combination," Science, Dec. 21, 2018, 362(6421):1416-1422, 8 pages.
Sagiv et al., "Granule exocytosis mediates immune surveillance of senescent cells," Oncogene, 2013, 32(15):1971-1977.
Sakaguchi et al., "Regulatory T Cells and Human Disease," Annual Review of Immunology, Apr. 26, 2020, 38:541-566.
Sakaguchi et al., "Regulatory T Cells and Immune Tolerance," Cell, May 30, 2008, 133(5):775-787.
Sakaguchi et al., "Regulatory T cells: how do they suppress immune responses?" International Immunology, Sep. 7, 2009, 21(10):1105-1111.
Sakamoto et al., "Phase I clinical trial of autologous NK cell therapy using novel expansion method in patients with advanced digestive cancer," Journal of Translational Medicine, Aug. 25, 2015, 13:277, 13 pages.
Sakamuri et al., "Measurement of respiratory function in isolated cardiac mitochondria using Seahorse XFe24 Analyzer: applications for aging research," Geroscience, Jun. 1, 2018, 40(3):347-356.
Salminen et al., "Emerging role of NF-κB signaling in the induction of senescence-associated secretory phenotype (SASP)," Cellular Signaling, Apr. 2012, 24(4):835-845.
Sandusky et al., "Regulation of 2B4 (CD244)-mediated NK cell activation by ligand-induced receptor modulation," European Journal of Immunology, Dec. 2006, 36(12):3268-76.
Sato et al., "Recombinant soluble murine IL-4 receptor can inhibit or enhance IgE responses in vivo," The Journal of Immunology, Apr. 1, 1993, 150:2717-2723.
Schafer et al., "Cellular senescence mediates fibrotic pulmonary disease," Nat Commun., Feb. 2017, 8:14532, 11 pages.
Schullek et al., "Key ligand interface residues in tissue factor contribute independently to factor VIIa binding," Journal of Biological Chemistry, Jul. 29, 1994, 269(30):19399-403.
Schwoppe et al., "Tissue-factor fusion proteins induce occlusion of tumor vessels," Thrombosis Research, Apr. 1, 2010, 125:S143-S150.
Seo et al., "Positive Feedback Loop between Plasminogen Activator Inhibitor-1 and Transforming Growth Factor-Beta1 during Renal Fibrosis in Diabetes," American Journal of Nephrology, Sep. 25, 2009, 30:481-490.
Sharkey et al., "Improved Therapeutic Results by Pretargeted Radioimmunotherapy of Non-Hodgkin's Lymphoma with a New Recombinant, Trivalent, Anti-CD20, Bispecific Antibody," Cancer Research, Jul. 1, 2008, 68(13):5282-90.
Sharma et al., "Regulatory T Cells License Macrophage Pro Resolving Functions During Atherosclerosis Regression," Circulation Research, Apr. 27, 2020, 127:335-353.
Smith et al., "Antigen Nature and Complexity Influence Human Antibody Light Chain Usage and Specificity," Vaccine, 2016, 34(25): 2813-2820.
Smith et al., "Development and evaluation of an optimal human single-chain variable fragment-derived BCMA-targeted CAR T cell vector," Molecular Therapy, Jun. 6, 2018, 26(6):1447-56.
Soerensen et al., "Safety, PK/PD, and anti-tumor activity of RO6874281, an engineered variant of interleukin-2 (IL-2v) targeted to tumor-associated fibroblasts via binding to fibroblast activation protein (FAP)," Journal of Clinical Oncology, Jun. 1, 2018, 36(No. 15 Suppl.):e15155, 2 pages.
Sondel et al., "Combination Therapy with Interleukin-2 and Anti-tumor Monoclonal Antibodies," Cancer Journal from Scientific American, Jan. 1, 1997, 3(Suppl. 1):S121-S127.
Sone et al., "Pancreatic beta cell senescence contributes to the pathogenesis of type 2 diabetes in high-fat diet-induced diabetic mice," Diabetologia, 2005, 48(1):58-67.

Song et al., "IL-12/IL-18-preactivated donor NK cells enhance GVL effects and mitigate GvHD after allogeneic hematopoietic stem cell transplantation," European Journal of Immunology, Apr. 2018, 48(4):670-682.
Soriani et al., "ATM-ATR-dependent up-regulation of DNAM-1 and NKG2D ligands on multiple myeloma cells by therapeutic agents results in enhanced NK-cell susceptibility and is associated with a senescent phenotype," Blood, Apr. 9, 2009, 113(15):3503-11.
Spiess et al., "Alternative molecular formats and therapeutic applications for bispecific antibodies," Molecular Immunology, Oct. 1, 2015, 67(2):95-106.
Stoklasek et al., "Combined IL-15/IL-15Rα Immunotherapy Maximizes IL-15 Activity In Vivo," The Journal of Immunology, Nov. 1, 2006, 177(9):6072-6080.
Storer et al., "Senescence Is a Developmental Mechanism that Contributes to Embryonic Growth and Patterning," Cell, Nov. 21, 2013, 155(5):1119-1130.
Stryer, Biochemistry Fourth Edition, W. H. Freeman and Company, New York, 1995, pp. 18-23, 8 pages.
Swanson et al., "The NLRP3 inflammasome: molecular activation and regulation to therapeutics," Nature Reviews Immunology, Apr. 29, 2019, 19(8):477-489, 13 pages.
Szalay et al., "Cutting edge: anti-CD1 monoclonal antibody treatment reverses the production patterns of TGF-β2 and Th1 cytokines and ameliorates listeriosis in mice," The Journal of Immunology, Jun. 15, 1999, 162(12):6955-8.
Tahara-Hanaoka et al., "Functional characterization of DNAM-1 (CD226) interaction with its ligands PVR (CD155) and nectin-2 (PRR-2/CD112)," International Immunology, Apr. 1, 2004, 16(4):533-8.
Takahashi et al., "Downregulation of cytoplasmic DNases is implicated in cytoplasmic DNA accumulation and SASP in senescent cells," Nature Communications, Mar. 28, 2018, 9:1249, 12 pages.
Takahashi et al., "Simple and inexpensive technique for measuring oxygen consumption rate in adherent cultured cells," The Journal of Physiological Sciences, Nov. 2017, 67(6):731-737.
Takeda et al., "Phase I study of YS110, a recombinant humanized monoclonal antibody to CD26, in Japanese patients with advanced malignant pleural mesothelioma," Lung Cancer, Nov. 2019, 137:64-70.
Tanaka et al., "Cloning and functional expression of the T cell activation antigen CD26," Journal of Immunology, Jul. 15, 1992, 149(2):481-486.
Tang et al., "The Foxp3+ regulatory T cell: a jack of all trades, master of regulation," Nature Immunology, Feb. 19, 2008, 9(3):239-244.
Teissier et al., "The receptor for advanced glycation end-products (RAGE) is an important pattern recognition receptor (PRR) for inflammaging," Biogerontology, Apr. 9, 2019, 20(3):279-301, 23 pages.
Teng et al., "Structural assessment of the effects of amino acid substitutions on protein stability and protein proteininteraction," International journal of computational biology and drug design, Feb. 7, 2011, 3(4):334-349.
Theil et al., "Adoptive transfer of allogeneic regulatory T cells into patients with chronic graft-versus-host disease," Cytotherapy, Apr. 2015, 17(4):473-486, 14 pages.
Thonhoff et al., "Expanded autologous regulatory T-lymphocyte infusions in ALS," Neurology Neuroimmunology Neuroinflammation, May 18, 2018, 5(4):e465, 8 pages.
Tobin et al., "NK cells in childhood obesity are activated, metabolically stressed, and functionally deficient," JCI Insight, Dec. 21, 2017, 2(24):e94939, 9 pages.
Tomala et al., "In Vivo Expansion of Activated Naive CD8+ T Cells and NK Cells Driven by Complexes of IL-2 and Anti-IL-2 Monoclonal Antibody as Novel Approach of Cancer Immunotherapy," The Journal of Immunology, Oct. 15, 2009, 183:4904-4912.
Tominaga et al., "TGF-β Signaling in Cellular Senescence and Aging-Related Pathology," International Journal of Molecular Sciences, Oct. 10, 2019, 20(20):5002, 18 pages.
Trevani et al., "Extracellular acidification induces human neutrophil activation," The Journal of Immunology, Apr. 15, 1999, 162(8):4849-4857.

(56) References Cited

OTHER PUBLICATIONS

Tse et al., "ABT-263: A Potent and Orally Bioavailable Bcl-2 Family Inhibitor," Cancer Research, May 2008, 68(9):3421-3428.
Uryga et al., "Ageing induced vascular smooth muscle cell senescence in atherosclerosis," Journal of Physiology, Apr. 15, 2016, 594(8):2115-2124.
Vaishampayan et al., "A phase I trial of ALKS 4230, an engineered cytokine activator of NK and effector T cells, in patients with advanced solid tumors," Journal of Clinical Oncology, 2017, 35(15 Suppl.):TPS3111, 4 pages (Abstract Only).
Van Audenhove et al., "Nanobodies as versatile tools to understand, diagnose, visualize and treat cancer," EBioMedicine, Jun. 1, 2016, 8:40-8.
Van den Bergh et al., "IL-15 receptor alpha as the magic wand to boost the success of IL-15 antitumor therapies: The upswing of IL-15 transpresentation," Pharmacology and Therapeutics, 2017, 170:73-79.
Van Deursen, "The role of senescent cells in ageing," Nature, May 21, 2014, 509(7501):439-446.
Vankadari et al., "Emerging COVID-19 coronavirus: glycan shield and structure prediction of spike glycoprotein and its interaction with human CD26," Emerging Microbes and Infection, Mar. 17, 2020, 9(1):601-604.
Vidarsson et al., "IgG subclasses and allotypes: from structure to effector functions," Frontiers in immunology, Oct. 20, 2014, 5:520, 17 Pages.
Vincke et al., "Introduction to heavy chain antibodies and derived Nanobodies," Single Domain Antibodies, Humana Press, Totowa, NJ, 2012, pp. 15-26.
Von Kobbe, "Cellular senescence: a view throughout organismal life," Cellular and Molecular Life Sciences, Jul. 20, 2018, 75:3553-3567, 15 pages.
Waaijer et al., "Do senescence markers correlate in vitro and in situ within individual human donors?," Aging Feb. 2018, 10(2):278-289.
Walsh et al., "Inflammasomes in the CNS," Nature Reviews Neuroscience, Jan. 8, 2014, 15(2):84-97, 14 pages.
Wang et al., A New Recombinant Single Chain Trispecific Antibody Recruits T Lymphocytes to Kill CEA (Carcinoma Embryonic Antigen) Positive Tumor Cells In Vitro Efficiently, Journal of Biochemisty, 2004, 135(4):555-565 DOI: 10.1093/jb/mvh065.
Wang et al., "Biomarkers of Cellular Senescence and Skin Aging," Frontiers in Genetics, Aug. 23, 2018, 9:247, 14 pages.
Wang et al., "Loss of lamin B1 is a biomarker to quantify cellular senescence in photoaged skin," Scientific Reports, Nov. 15, 2017, 7(1):15678, 8 pages.
Wang et al., "Recombinant human CD137L for cancer immunotherapy: effects of different fusions and linkers on its activity," Cancer Immunol Immunother., 2012, 61(4):489-495.
Washburn et al., "A potential role for shed soluble major histocompatibility class I molecules as modulators of neurite outgrowth," PLoS One, Mar. 31, 2011, 6(3):e18439.
Weber et al., "Specific low-affinity recognition of major histocompatibility complex plus peptide by soluble T-cell receptor," Nature, Apr. 1992, 356(6372):793.
Weihermann et al., "Elastin structure and its involvement in skin photoageing," International Journal of Cosmetic Science, Jun. 2017, 39(3):241-247.
Weihofen et al., "Crystal Structure of CD26/Dipeptidyl-peptidase IV in Complex with Adenosine Deaminase Reveals a Highly Amphiphilic Interface," Journal of Biological Chemistry, Oct. 2004, 279(41):43330-43335.
Weiner et al., "Antibody-based immunotherapy of cancer," Cell, Mar. 16, 2012, 148(6):1081-4.
Weiss et al., "Formyl-Peptide Receptors in Infection, Inflammation, and Cancer," Trends in Immunology, Oct. 2018, 39(10):815-829, 15 pages.
Wesolowski et al., "Single domain antibodies: promising experimental and therapeutic tools in infection and immunity," Medical Microbiology and Immunology. Aug. 1, 2009, 198(3):157-74.
Wiemann et al., "Hepatocyte telomere shortening and senescence are general markers of human liver cirrhosis," The FASEB Journal, Jul. 2002, 16(9):935-942.
Wiley et al., "Mitochondrial Dysfunction Induces Senescence with a Distinct Secretory Phenotype," Cell Metabolism, Feb. 9, 2016, 23(2):303-314.
Witkowsa et al., "Soluble intercellular adhesion molecule-1 (sICAM-1): an overview," Eur Cytokine Netw. 2004, 15(2):91-98.
Xiong et al., "Maternal uterine NK cell-activating receptor KIR2DS1 enhances placentation," The Journal of Clinical Investigation, Oct. 1, 2013, 123(10):4264-72.
Xu et al., "JAK inhibition alleviates the cellular senescence-associated secretory phenotype and frailty in old age," Proceedings of the National Academy of Sciences U.S.A., Nov. 17, 2015, 112(46):E6301-6310, 10 pages.
Xu et al., "Senolytics improve physical function and increase lifespan in old age," Nature Medicine, Aug. 2018, 24(8):1246, 15 pages.
Xu et al., "Transplanted senescent cells induce an osteoarthritis-like condition in mice," The Journals of Gerontology: Series A, Jun. 1, 2017, 72(6):780-5.
Yamamoto et al., "Measurement of glucose uptake in cultured cells," Curr Protoc Pharmacol, Dec. 2011, Chapter 12:12.14.1-12.14.22.
Yamazaki et al., "Vascular Cell Senescence Contributes to Blood-Brain Barrier Breakdown," Stroke, Feb. 16, 2016, 47(4):1068-1077, 15 pages.
Yan et al., "Obesity- and aging-induced excess of central transforming growth factor-β potentiates diabetic development via an RNA stress response," Nature Medicine, Aug. 3, 2014, 20:1001-1008, 9 pages.
Yanai et al., "Cellular senescence-like features of lung fibroblasts derived from idiopathic pulmonary fibrosis patients," Aging (Albany NY), Sep. 2015, 7(9):664-672.
Yigit et al., "A combination of an anti-SLAMF6 antibody and ibrutinib efficiently abrogates expansion of chronic lymphocytic leukemia cells," Oncotarget, May 3, 2016, 7(18):26346.
Yousefzadeh et al., "An aged immune system drives senescence and ageing of solid organs," Nature, May 12, 2021, 594:100-105, 34 pages.
Yu et al., "Targeting the Senescence-Overriding Cooperative Activity of Structurally Unrelated H3K9 Demethylases in Melanoma," Cancer Cell, Feb. 12, 2018, 33(2):322-336, 23 pages.
Yu et al., "The dipeptidyl peptidase IV family in cancer and cell biology," FEBS Journal, Feb. 5, 2010, 277(5):1126-1144.
Yun et al., "Recurrent turnover of senescent cells during regeneration of a complex structure," Elife, May 5, 2015, 4:e05505, 16 pages.
Yung et al., "A selective transforming growth factor-β ligand trap attenuates pulmonary hypertension," American Journal of Respiratory and Critical Care Medicine, Nov. 1, 2016, 194(9):1140-51.
Zhang et al., "AAED1 modulates proliferation and glycolysis in gastric cancer," Oncology Reports, Aug. 1, 2018, 40(2):1156-1164.
Zhang et al., "The bone anabolic effects of irisin are through preferential stimulation of aerobic glycolysis," Bone, Sep. 1, 2018, 114:150-160.
Zhao et al., "Histone Deacetylase-3 Modification of MicroRNA-31 Promotes Cell Proliferation and Aerobic Glycolysis in Breast Cancer and Is Predictive of Poor Prognosis," Journal of breast cancer, Jun. 1, 2018, 21(2):112-123.
Zheng et al., "Acquisition of Suppressive Function by Activated Human CD4+CD25-T Cells Is Associated with the Expression of CTLA-4 Not FoxP3," The Journal of Immunology, Aug. 1, 2008, 181(3):1683-1691.
Zhong et al., "A Potential Role for Dendritic Cell/Macrophage-Expressing DPP4 in Obesity-Induced Visceral Inflammation," Diabetes, Jan. 2013, 62(1):149-157.
Zhou et al., "A novel chimeric antigen receptor redirecting T-cell specificity towards CD26cancer cells," Leukemia, Apr. 2020, 35(1):119-129, 11 pages.
Zhu et al., "New agents that target senescent cells: the flavone, fisetin, and the BCL-XL inhibitors, A1331852 and A1155463," Aging (Albany NY), Mar. 2017, 9(3):955-963.

(56) References Cited

OTHER PUBLICATIONS

Zhu et al., "Novel Human Interleukin-15 Agonists," The Journal of Immunology, Sep. 15, 2009, 183(6):3598-3607.

Zou et al., "2-NBDG as a fluorescent indicator for direct glucose uptake measurement," Journal of biochemical and biophysical methods, Sep. 30, 2005, 64(3):207-215.

Zwaagstra et al., "Engineering and therapeutic application of single-chain bivalent TGF-β family traps," Molecular Cancer Therapeutics, Jul. 1, 2012, 11(7):1477-87.

Chen et al., "A novel idea for establishing Parkinson's disease mouse model by intranasal administration of paraquat" Neurological Research, 43(4):267-277, 2021.

Fernando et al., "Targeting tumor endothelial marker 8 in the tumor vasculature of colorectal carcinomas in mice," Cancer research, Jun. 15, 2009, 69(12):5126-5132.

Igarashi et al., "VEGF-C and TGF-β reciprocally regulate mesenchymal stem cell commitment to differentiation into lymphatic endothelial or osteoblastic phenotypes," International journal of molecular medicine, Apr. 1, 2016, 37(4):1005-1013.

Infante-Duarte et al., "New developments in understanding and treating neuroinflammation" Journal of Molecular Medicine, 86:975-985, Sep. 2008.

International Search Report and Written Opinion in International Appln. No. PCT/US2023/065745, mailed on Jun. 26, 2023, 14 pages.

Matsuura et al., "Pole test is a useful method for evaluating the mouse movement disorder caused by striatal dopamine depletion" Journal of neuroscience methods, 73(1):45-48, 1997.

Mortier et al., "Soluble interleukin-15 receptor α (IL-15Rα)-sushi as a selective and potent agonist of IL-15 action through IL-15Rβ/γ: hyperagonist IL-15• IL-15Rα fusion proteins," Journal of Biological Chemistry, Jan. 20, 2006, 281(3): 1612-1619.

Reddy et al., "Linkers in the structural biology of protein-protein interactions" Protein science, 22(2):153-167, 2013.

Ross et al., "Signaling and function of interleukin-2 in T lymphocytes" Annual review of immunology, 36:411-433, 2018.

Van Bockstaele et al., "The development of nanobodies for therapeutic applications" Current opinion in investigational drugs, 10(11):1212-1224, 2009.

Wong et al., "Interleukin-15: Interleukin-15 receptor α scaffold for creation of multivalent targeted immune molecules," Protein Engineering, Design & Selection, Apr. 1, 2011, 24(4):373-383.

Janeway et al., "The interaction of the antibody molecule with specific antigen," In Immunobiology: The Immune System in Health and Disease, 5th edition, 5 pages, 2001.

Shen et al., "Engineering peptide linkers for scFv immunosensors," Anal Chem., Mar. 2008, 80(6):1910-1917.

* cited by examiner

\* Statistically significant from High Fat Diet untreated Group

* Statistically significant from High fat diet untreated Group

* Statistically significant from Control Normal Diet Group

A

B

C

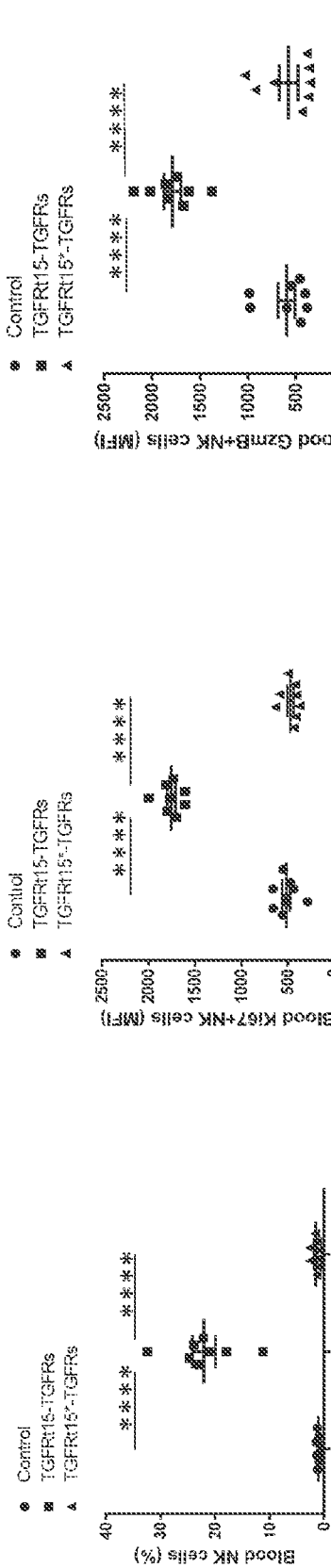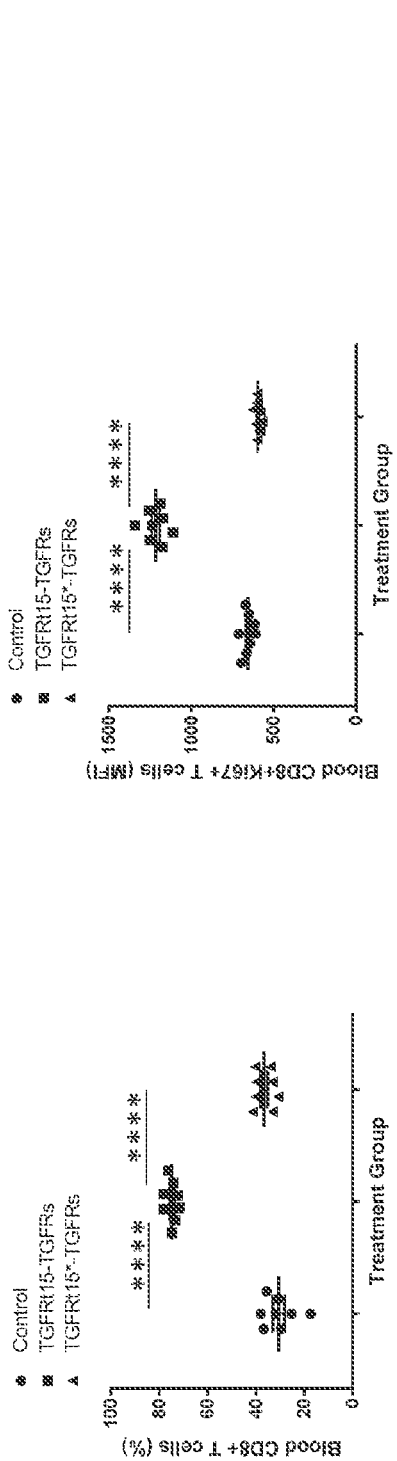

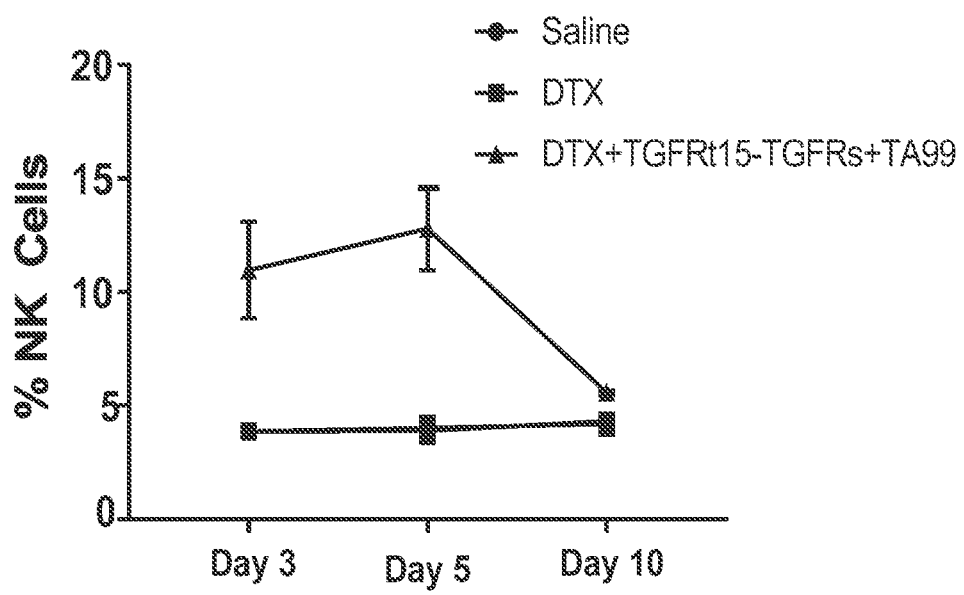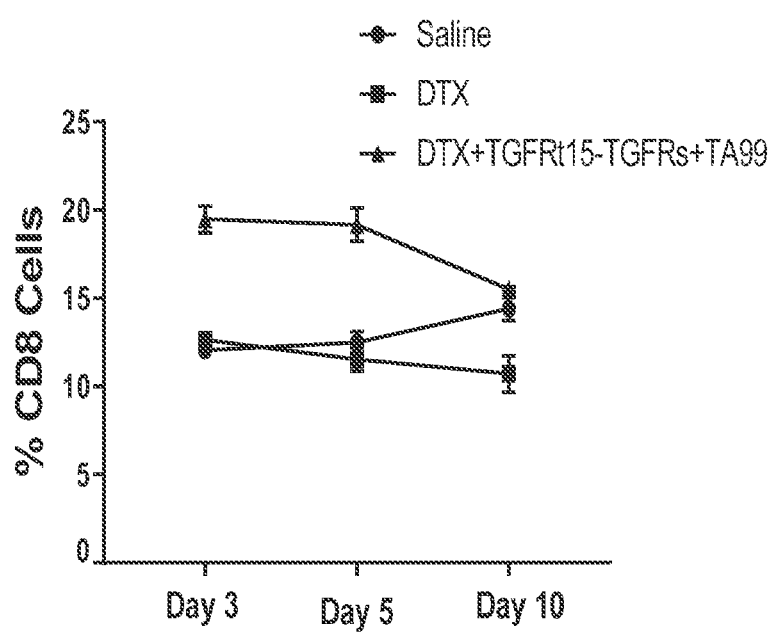
Figure 236

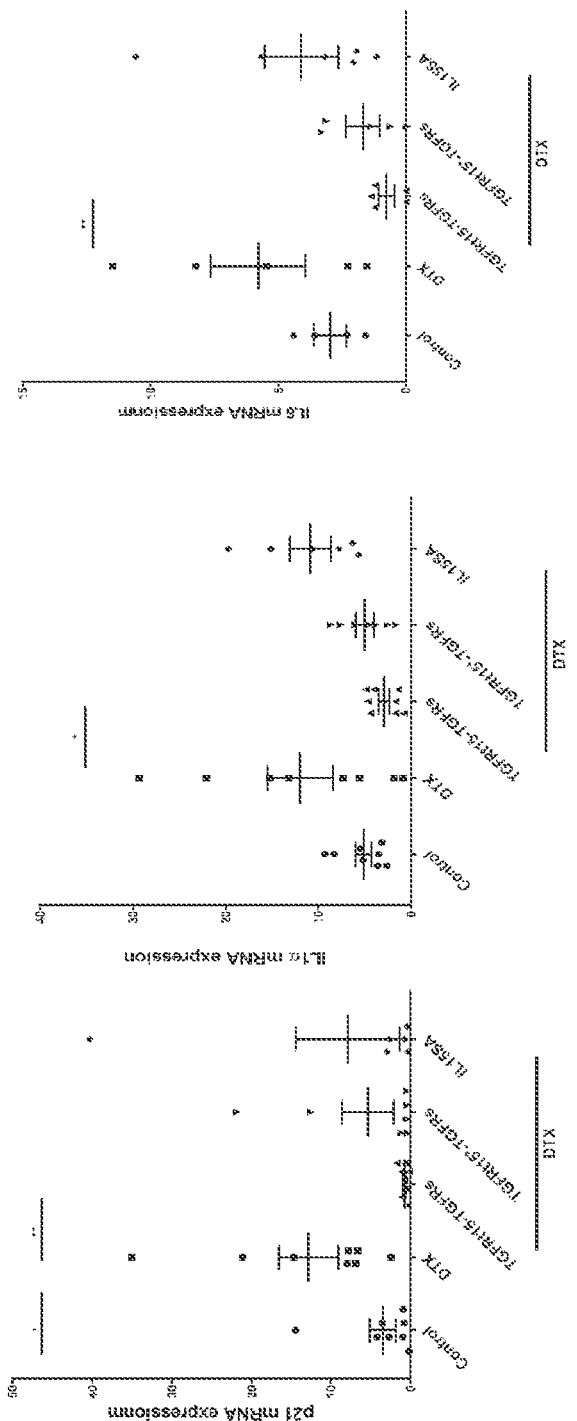
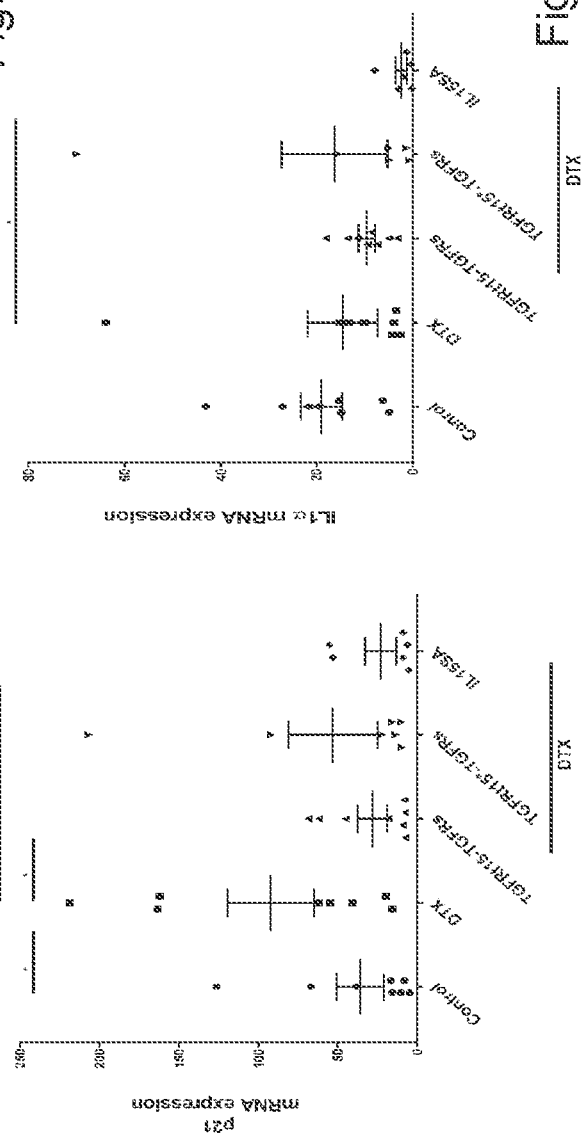
Figure 243A
Figure 243B

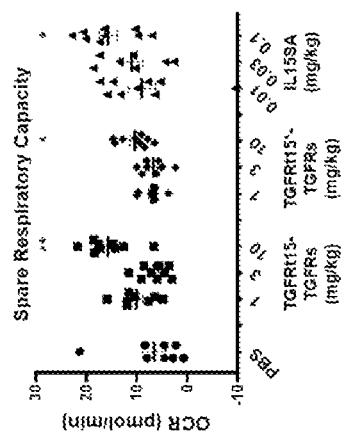
Figure 250B
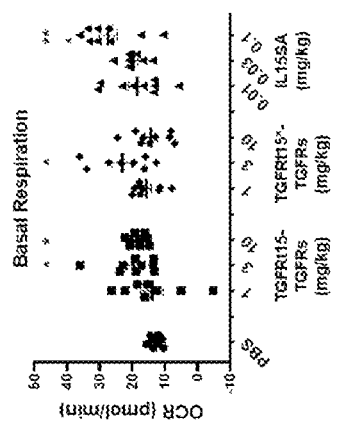
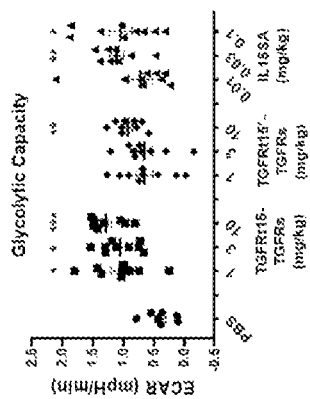
Figure 250A

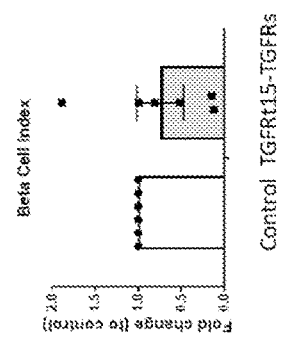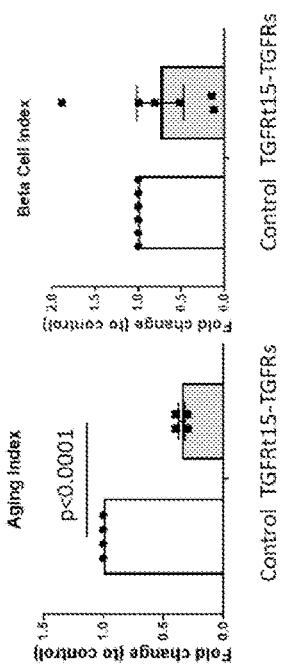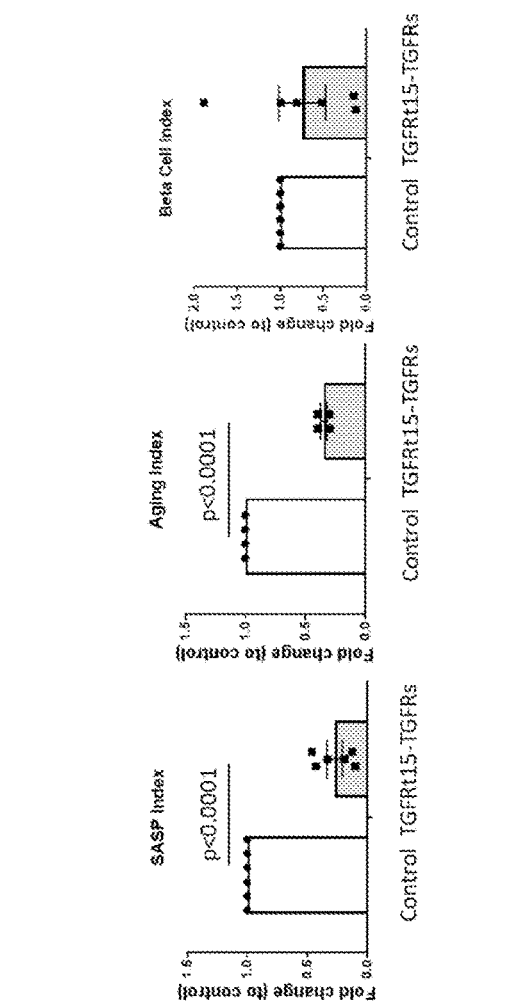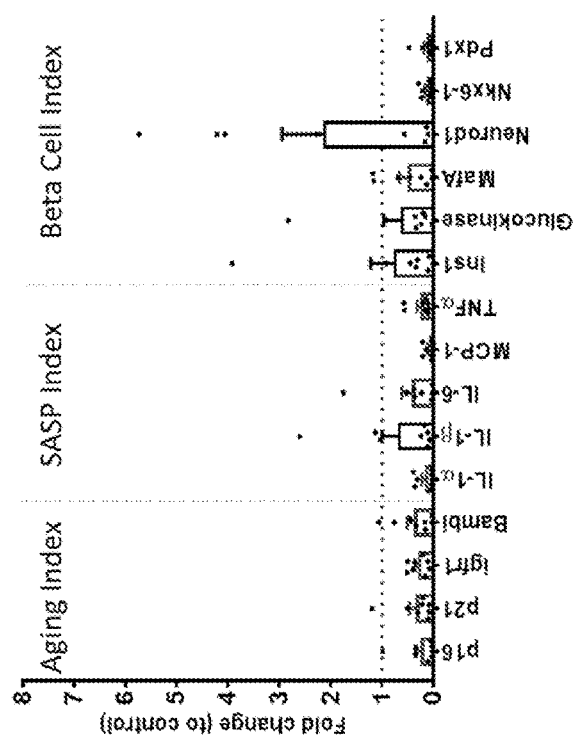
Figure 254A
Figure 254B
Figure 254C
Figure 254D

METHODS OF TREATING AGING-RELATED DISORDERS

CROSS-REFERENCE TO RELATED APPLICATION

This application claims priority to U.S. Provisional Patent Application Ser. No. 63/032,933, filed on Jun. 1, 2020 and U.S. Provisional Patent Application Ser. No. 63/118,536, filed on Nov. 25, 2020, each of which are incorporated herein by reference in its entirety.

SEQUENCE LISTING

This application contains a Sequence Listing that has been submitted electronically as an ASCII text file named "47039-0022001_SL.txt." This ASCII text file, created on Jun. 1, 2021, is 617,640 bytes in size. The material in the ASCII text file is hereby incorporated by reference in its entirety.

TECHNICAL FIELD

The present disclosure relates to the field of immunology and cell biology.

BACKGROUND

Senescence is a form of irreversible growth arrest accompanied by phenotypic changes, resistance to apoptosis, and activation of damage-sensing signaling pathways. Cellular senescence was first described in cultured human fibroblast cells that lost their ability to proliferate, reaching permanent arrest after about 50 population doublings (referred to as the Hayflick limit). Senescence is considered a stress response that can be induced by a wide range of intrinsic and extrinsic insults, including oxidative and genotoxic stress, DNA damage, telomere attrition, oncogenic activation, mitochondrial dysfunction, or chemotherapeutic agents.

Senescent cells remain metabolically active and can influence tissue hemostasis, disease, and aging through their secretory phenotype. Senescence is considered as a physiologic process and is important in promoting wound healing, tissue homeostasis, regeneration, and regulation of fibrosis. For instance, transient induction of senescent cells is observed during would healing and contributes to wound resolution. Senescence also plays a role in tumor suppression. The accumulation of senescent cells also drives aging and aging-related diseases and conditions. The senescent phenotype also can trigger chronic inflammatory responses and consequently augment chronic inflammatory conditions to promote tumor growth. The connection between senescence and aging was initially based on the observation that senescent cells accumulate in aged tissue. The use of transgenic models has enabled the detection of senescent cells systematically in many aging-related disorders. Strategies to selectively eliminate senescent cells have demonstrated that senescent cells play a causal role in aging-related disorders.

Cellular senescence is a series of progressive and phenotypically diverse cellular states that are acquired after initial growth arrest (van Deursen, Nature 509(7501):439-446, 2014) Thus, senescent cells are heterogeneous populations of cells with few shared core properties (Dou et al., Nature 550(7676):402-406, 2017). Identifying common senolytic drug targets, therefore, is difficult. This further precludes the achievement of a goal of developing senolytics that selectively, safety, and effectively eliminate senescent cells upon systemic administration. As described above, immune cells are the effector cells to remove senescent cells naturally after the fulfillment of senescent-cell physiological roles. (Brighton et al., Elife 6, 2017) The weakening of the immune system during the aging process allows the accumulation of senescent cells. (Karin et al., Nat. Comm. 10(1):5495, 2019; Chambers et al., J. Allergy Clin. Immunol. 145(5):1323-1331, 2020).

SUMMARY

The present invention is based on the discovery that subcutaneous administration of an agent that results in a decrease in the activation of a TGF-β receptor or a common gamma-chain family cytokine receptor activating agent (e.g., complexes of gamma-chain cytokines and their cognate receptors) to a mammal promotes and activates immune cells to regain their capabilities of reducing senescent cells in vivo effectively, selectively, and safely. In view of this discovery, provided herein are methods of killing or reducing the number of naturally-occurring and/or treatment-induced senescent cells in a subject that include administering to the subject a therapeutically effective amount of one or more agent(s) that result(s) in a decrease in the activation of a TGF-β receptor. Also provided herein are methods of decreasing the accumulation of naturally-occurring and/or treatment-induced senescent cells in a subject that include administering to the subject a therapeutically effective amount of one or more agent(s) that result(s) in a decrease in the activation of a TGF-β receptor. Also provided herein are methods of decreasing a level of a marker of naturally-occurring and/or treatment-induced senescent cells in a subject that include administering to the subject a therapeutically effective amount of one or more agent(s) that result(s) in a decrease in the activation of a TGF-β receptor. Also provided herein are methods of reducing the activity of naturally-occurring and/or treatment-induced senescent cells in a subject that include administering to the subject a therapeutically effective amount of one or more agent(s) that result(s) in a decrease in the activation of a TGF-β receptor. Also provided herein are methods of decreasing levels and/or activity of one or more senescence associated secretory phenotype ("SASP") factor(s) derived from naturally-occurring and/or treatment-induced senescent cells in a subject that include administering to the subject a therapeutically effective amount of one or more agent(s) that result(s) in a decrease in the activation of a TGF-β receptor.

Also provided herein are methods of killing and reducing the number of naturally-occurring and/or treatment-induced senescent cells (and methods of decreasing the accumulation or reducing markers of senescent cells) in a subject that include administering to the subject a therapeutically effective amount of one or more common gamma-chain family cytokine receptor activating agent(s) (e.g., complexes of gamma-chain cytokines and their cognate receptors). Also provided herein are methods of reducing the activity of naturally-occurring and/or treatment-induced senescent cells in a subject that include administering to the subject a therapeutically effective amount of one or more common gamma-chain family cytokine receptor activating agent(s). Also provided herein are methods of decreasing levels and/or activity of one or more SASP factor(s) derived from naturally-occurring and/or treatment-induced senescent cells in a subject that include administering to the subject a therapeutically effective amount of one or more common gamma-chain family cytokine receptor activating agent(s).

The present invention is also based on the discovery that administration of NK cell activating agents to a mammal having a cancer resulted in a tumor inhibition and administration of NK cell activating agents to a diabetic animal model demonstrated improved skin and hair appearance and texture, and decreased blood glucose levels. In view of this discovery provided herein are methods of treating an aging-related disease or condition in a subject in need thereof that include administering to a subject identified as having an aging-related disease or condition a therapeutically effective amount of one or more natural killer (NK) cell activating agent(s) and/or a therapeutically effective number of activated NK cells. Also provided herein are methods of killing or reducing the number of senescent cells in a subject in need thereof that include administering to the subject a therapeutically effective amount of one or more NK cell activating agent(s) and/or or a therapeutically effective number of activated NK cells. Also provided herein are methods of improving the texture and/or appearance of skin and/or hair in a subject in need thereof over a period of time that include administering to the subject a therapeutically effective amount of one or more natural killer (NK) cell activating agent(s) and/or a therapeutically effective number of activated NK cells. Also provided herein are methods of assisting in the treatment of obesity in a subject in need thereof over a period of time that include administering to the subject a therapeutically effective amount of one or more natural killer (NK) cell activating agent(s) and/or a therapeutically effective number of activated NK cells.

Provided herein are methods of killing or reducing the number of naturally-occurring and/or treatment-induced senescent cells in a subject that include administering to the subject a therapeutically effective amount of one or more agent(s) that result(s) in a decrease in the activation of a TGF-β receptor.

Also provided herein are methods of decreasing the accumulation of naturally-occurring and/or treatment-induced senescent cells in a subject that include administering to the subject a therapeutically effective amount of one or more agent(s) that result(s) in a decrease in the activation of a TGF-β receptor.

Also provided herein are methods of decreasing a level of a marker of naturally-occurring and/or treatment-induced senescent cells in a subject that include administering to the subject a therapeutically effective amount of one or more agent(s) that result(s) in a decrease in the activation of a TGF-β receptor.

Also provided herein are methods of reducing the activity of naturally-occurring and/or treatment-induced senescent cells in a subject that include administering to the subject a therapeutically effective amount of one or more agent(s) that result(s) in a decrease in the activation of a TGF-β receptor.

Also provided herein are methods of decreasing levels and/or activity of one or more SASP factor(s) derived from naturally-occurring and/or treatment-induced senescent cells in a subject that include administering to the subject a therapeutically effective amount of one or more agent(s) that result(s) in a decrease in the activation of a TGF-β receptor.

In some embodiments of any of the methods described herein, the subject has been previously diagnosed or identified as having an aging-related disease or an inflammatory disease. In some embodiments of any of the methods described herein, the aging-related disease is inflamm-aging related. In some embodiments of any of the methods described herein, the aging-related disease is selected from the group of: Alzheimer's disease, aneurysm, cystic fibrosis, fibrosis in pancreatitis, glaucoma, hypertension, inflammatory bowel disease, intervertebral disc degeneration, osteoarthritis, type 2 diabetes mellitus, adipose atrophy, lipodystrophy, atherosclerosis, cataracts, COPD, idiopathic pulmonary fibrosis, kidney transplant failure, liver fibrosis, loss of bone mass, myocardial infarction, sarcopenia, wound healing, alopecia, cardiomyocyte hypertrophy, osteoarthritis, Parkinson's disease, age-associated loss of lung tissue elasticity, age-related macular degeneration, cachexia, glomerulosclerosis, liver cirrhosis, NAFLD, osteoporosis, amyotrophic lateral sclerosis, Huntington's disease, spinocerebellar ataxia, multiple sclerosis, neurodegeneration, stroke, cancer, dementia, vascular disease, infection susceptibility, chronic inflammation, and renal dysfunction. In some embodiments of any of the methods described herein, the aging-related disease is a cancer selected from the group consisting of: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, B-cell lymphoma, B-cell non-Hodgkin's lymphoma, Hodgkin's lymphoma, chronic lymphocytic leukemia (CLL), acute myeloid leukemia (AML), chronic myeloid leukemia (CML), acute lymphocytic leukemia (ALL), myelodysplastic syndromes (MDS), cutaneous T-cell lymphoma, retinoblastoma, stomach cancer, urothelial carcinoma, lung cancer, renal cell carcinoma, gastric and esophageal cancer, pancreatic cancer, prostate cancer, breast cancer, colorectal cancer, ovarian cancer, non-small cell lung carcinoma, squamous cell head and neck carcinoma, endometrial cancer, cervical cancer, liver cancer, and hepatocellular carcinoma. In some embodiments of any of the methods described herein, the inflammatory disease is selected from the group of: rheumatoid arthritis, inflammatory bowel disease, lupus erythematosus, lupus nephritis, diabetic nephropathy, CNS injury, Alzheimer's disease, Parkinson's disease, amyotrophic lateral sclerosis, Crohn's disease, multiple sclerosis, Guillain-Barre syndrome, psoriasis, Grave's disease, ulcerative colitis, nonalcoholic steatohepatitis, mood disorders and cancer treatment-related cognitive impairment.

In some embodiments of any of the methods described herein, the treatment-induced senescent cells are chemotherapy-induced senescent cells. In some embodiments of any of the methods described herein, the administration of the one or more agent(s) that result(s) in a decrease in the activation of a TGF-β receptor results in a decrease in the number or activity of naturally-occurring senescent cells and/or treatment-induced senescent cells in a target tissue in the subject. In some embodiments of any of the methods described herein, the target tissue is selected from the group of: adipose tissue, pancreatic tissue, liver tissue, kidney tissue, lung tissue, heart tissue, vasculature, bone tissue, central nervous system (CNS) tissue, eye tissue, skin tissue, muscle tissue, and secondary lympho-organ tissue.

In some embodiments of any of the methods described herein, the TGF-β receptor is a TGF-β receptor II (TGFβRII). In some embodiments of any of the methods described herein, the TGFβ receptor is a TGFβRIII.

In some embodiments of any of the methods described herein, at least one of the one or more agent(s) that result(s) in a decrease in the activation of a TGF-β receptor is a soluble TGF-β receptor, an extracellular domain of TGF-β receptor, an antibody that binds specifically to TGF-β, an antagonistic antibody that binds to a TGF-β receptor, an agent that binds to a latency-associated peptide ("LAP"), or an agent that binds to a TGF-β/LAP complex. In some embodiments of any of the methods described herein, the one or more agent(s) that result(s) in a decrease in the activation of a TGF-β receptor decrease(s) the activation of a TGF-β receptor through binding to a LAP, or to a TGF-β/LAP complex.

In some embodiments of any of the methods described herein, at least one of the one or more agent(s) that result(s) in a decrease in the activation of a TGF-β receptor is a multi-chain chimeric polypeptide including: (a) a first chimeric polypeptide comprising: (i) a first target-binding domain; (ii) a soluble tissue factor domain; and (iii) a first domain of a pair of affinity domains; (b) a second chimeric polypeptide comprising: (i) a second domain of a pair of affinity domains; and (ii) a second target-binding domain, where one or both of the first target-binding domain and the second target-binding domain binds specifically to a ligand of a TGF-β receptor; or one or both of the first target-binding domain and the second target-binding domain is an antagonistic antigen-binding domain that binds specifically to a TGF-β receptor. In some embodiments of any of the methods described herein, the TGF-β receptor is TGFβRII. In some embodiments of any of the methods described herein, the TGF-β receptor is TGFβRIII.

In some embodiments of any of the methods described herein, the first target-binding domain and the soluble tissue factor domain directly abut each other in the first chimeric polypeptide. In some embodiments of any of the methods described herein, the first chimeric polypeptide further includes a linker sequence between the first target-binding domain and the soluble tissue factor domain in the first chimeric polypeptide.

In some embodiments of any of the methods described herein, the soluble tissue factor domain and the first domain of the pair of affinity domains directly abut each other in the first chimeric polypeptide. In some embodiments of any of the methods described herein, the first chimeric polypeptide further includes a linker sequence between the soluble tissue factor domain and the first domain of the pair of affinity domains in the first chimeric polypeptide.

In some embodiments of any of the methods described herein, the second domain of the pair of affinity domains and the second target-binding domain directly abut each other in the second chimeric polypeptide. In some embodiments of any of the methods described herein, the second chimeric polypeptide further includes a linker sequence between the second domain of the pair of affinity domains and the second target-binding domain in the second chimeric polypeptide.

In some embodiments of any of the methods described herein, the first target-binding domain and the second target-binding domain bind specifically to the same antigen. In some embodiments of any of the methods described herein, the first target-binding domain and the second target-binding domain bind specifically to different antigens. In some embodiments of any of the methods described herein, the first chimeric polypeptide further comprises one or more additional target-binding domain(s). In some embodiments of any of the methods described herein, the second chimeric polypeptide further comprises one or more additional target-binding domain(s).

In some embodiments of any of the methods described herein, the soluble tissue factor domain is a soluble human tissue factor domain. In some embodiments of any of the methods described herein, the soluble human tissue factor domain comprises a sequence that is at least 80% identical to SEQ ID NO: 93.

In some embodiments of any of the methods described herein, the pair of affinity domains is a sushi domain from an alpha chain of human IL-15 receptor (IL15Rα) and a soluble IL-15. In some embodiments of any of the methods described herein, the soluble IL-15 has a D8N or D8A amino acid substitution. In some embodiments of any of the methods described herein, the soluble IL-15 comprises a mutation to reduce or eliminate IL-15 activity.

In some embodiments of any of the methods described herein, the pair of affinity domains is selected from the group of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25. In some embodiments of any of the methods described herein, the first domain or the second domain of a pair of affinity domains is a soluble common gamma-chain family cytokine or an antigen-binding domain that binds specifically to a common gamma-chain family cytokine receptor.

In some embodiments of any of the methods described herein, the first target-binding domain and/or the second target-binding domain include a soluble TGF-β receptor. In some embodiments of any of the methods described herein, the soluble TGF-β receptor is a soluble TGFβRII. In some embodiments of any of the methods described herein, the soluble TGFβRII includes a first sequence that is at least 80% identical to SEQ ID NO: 183, and a second sequence that is at least 80% identical to SEQ ID NO: 183, wherein the first and second sequence are separated by a linker. In some embodiments of any of the methods described herein, the soluble TGFβRII comprises a first sequence that is at least 90% identical to SEQ ID NO: 183, and a second sequence that is at least 90% identical to SEQ ID NO: 183. In some embodiments of any of the methods described herein, the soluble TGFβRII includes a first sequence of SEQ ID NO: 183, and a second sequence of SEQ ID NO: 183. In some embodiments of any of the methods described herein, the linker includes a sequence of SEQ ID NO: 102. In some embodiments of any of the methods described herein, the soluble TGFβRII includes a sequence that is at least 80% identical to SEQ ID NO: 188. In some embodiments of any of the methods described herein, the soluble TGFβRII includes a sequence that is at least 90% identical to SEQ ID NO: 188. In some embodiments of any of the methods described herein, the soluble TGF-βRII includes a sequence of SEQ ID NO: 188.

In some embodiments of any of the methods described herein, the first chimeric polypeptide includes a sequence that is at least 80% identical to SEQ ID NO: 236. In some embodiments of any of the methods described herein, the first chimeric polypeptide includes a sequence that is at least 90% identical to SEQ ID NO: 236. In some embodiments of any of the methods described herein, the first chimeric polypeptide includes a sequence of SEQ ID NO: 236. In some embodiments of any of the methods described herein, the second chimeric polypeptide includes a sequence that is at least 80% identical to SEQ ID NO: 193. In some embodiments of any of the methods described herein, the first chimeric polypeptide includes a sequence that is at least 80% identical to SEQ ID NO: 236. In some embodiments of any of the methods described herein, the second chimeric polypeptide includes a sequence that is at least 90% identical to SEQ ID NO: 193. In some embodiments of any of the methods described herein, the second chimeric polypeptide includes a sequence of SEQ ID NO: 193. In some embodiments of any of the methods described herein, the first chimeric polypeptide comprises a sequence of SEQ ID NO: 236.

In some embodiments of any of the methods described herein, at least one of the one or more agent(s) that result(s) in a decrease in the activation of a TGF-β receptor is a single-chain chimeric polypeptide including: (i) a first target-binding domain; (ii) a soluble tissue factor domain; and (iii) a second target-binding domain, wherein one or both of the first target-binding domain and the second target-binding domain binds specifically to a ligand of a TGF-β receptor; or one or both of the first target-binding domain and the second target-binding domain is an antagonistic antigen-binding domain that binds specifically to a TGF-β receptor. In some embodiments of any of the methods described herein, the TGF-β receptor is TGF-βRII. In some embodiments of any of the methods described herein, the TGF-β receptor is TGFβRIII.

In some embodiments of any of the methods described herein, the first target-binding domain and the soluble tissue factor domain directly abut each other. In some embodiments of any of the methods described herein, the single-chain chimeric polypeptide further includes a linker sequence between the first target-binding domain and the soluble tissue factor domain. In some embodiments of any of the methods described herein, the soluble tissue factor domain and the second target-binding domain directly abut each other. In some embodiments of any of the methods described herein, the single-chain chimeric polypeptide further includes a linker sequence between the soluble tissue factor domain and the second target-binding domain.

In some embodiments of any of the methods described herein, the first target-binding domain and the second target-binding domain bind specifically to the same antigen. In some embodiments of any of the methods described herein, the first target-binding domain and the second target-binding domain bind specifically to different antigens.

In some embodiments of any of the methods described herein, the soluble tissue factor domain is a soluble human tissue factor domain. In some embodiments of any of the methods described herein, the soluble human tissue factor domain includes a sequence that is at least 80% identical to SEQ ID NO: 93.

In some embodiments of any of the methods described herein, the single-chain chimeric polypeptide further includes one or more additional target-binding domains at its N- and/or C-terminus. In some embodiments of any of the methods described herein, the first target-binding domain and/or the second target-binding domain comprise a soluble TGF-β receptor. In some embodiments of any of the methods described herein, the soluble TGF-β receptor is a soluble TGF-βRII.

In some embodiments of any of the methods described herein, the soluble TGF-βRII includes a first sequence that is at least 80% identical to SEQ ID NO: 183, and a second sequence that is at least 80% identical to SEQ ID NO: 183, wherein the first and second sequence are separated by a linker. In some embodiments of any of the methods described herein, the soluble TGFβRII includes a first sequence that is at least 90% identical to SEQ ID NO: 183, and a second sequence that is at least 90% identical to SEQ ID NO: 183. In some embodiments of any of the methods described herein, the soluble TGFβRII includes a first sequence of SEQ ID NO: 183, and a second sequence of SEQ ID NO: 183. In some embodiments of any of the methods described herein, the linker includes a sequence of SEQ ID NO: 102. In some embodiments of any of the methods described herein, the soluble TGFβRII includes a sequence that is at least 80% identical to SEQ ID NO: 188. In some embodiments of any of the methods described herein, the soluble TGFβRII includes a sequence that is at least 90% identical to SEQ ID NO: 188. In some embodiments of any of the methods described herein, the soluble TGFβRII includes a sequence of SEQ ID NO: 188.

In some embodiments of any of the methods described herein, the method includes administering two or more doses of the one or more agent(s) that result(s) in a decrease in the activation of a TGF-β receptor to the subject. In some embodiments of any of the methods described herein, any two consecutive doses of the two or more doses are administered about 1 week to about one year apart. In some embodiments of any of the methods described herein, any two consecutive doses of the two or more doses are administered about 1 week to about 6 months apart. In some embodiments of any of the methods described herein, any two consecutive doses of the two or more doses are administered about 1 week to about 2 months apart. In some embodiments of any of the methods described herein, any two consecutive doses of the two or more doses are administered about 1 week to about 1 month apart.

In some embodiments of any of the methods described herein, the two or more doses are administered by subcutaneous administration. In some embodiments of any of the methods described herein, the two or more doses are administered by intramuscular administration.

In some embodiments of any of the methods described herein, the two or more doses are administered over a period of time of about 1 year to about 60 years. In some embodiments of any of the methods described herein, the two or more doses are administered over a period of time of about 1 year to about 50 years. In some embodiments of any of the methods described herein, the two or more doses are administered over a period of time of about 1 year to about 40 years. In some embodiments of any of the methods described herein, the two or more doses are administered over a period of time of about 1 year to about 30 years. In some embodiments of any of the methods described herein, the two or more doses are administered over a period of time of about 1 year to about 20 years. In some embodiments of any of the methods described herein, the two or more doses are administered over a period of time of about 1 year to about 10 years.

In some embodiments of any of the methods described herein, a first dose of the one or more agent(s) that result(s) in a decrease in the activation of a TGF-β receptor begins when the subject reaches an age of at least 30 years. In some embodiments of any of the methods described herein, a first dose of the one or more agent(s) that result(s) in a decrease in the activation of a TGF-β receptor begins when the subject reaches an age of at least 40 years. In some embodiments of any of the methods described herein, a first dose of the one or more agent(s) that result(s) in a decrease in the activation of a TGF-β receptor begins when the subject reaches an age of at least 50 years. In some embodiments of any of the methods described herein, a first dose of the one or more agent(s) that result(s) in a decrease in the activation of a TGF-β receptor begins when the subject reaches an age of at least 60 years.

In some embodiments of any of the methods described herein, each of the two or more doses are administered at a dosage of about 0.01 mg of each agent that results in a decrease in the activation of a TGF-β receptor/kg to about 10 mg of each agent that results in a decrease in the activation of a TGF-β receptor/kg. In some embodiments of any of the methods described herein, each of the two or more doses are administered at a dosage of about 0.02 mg of each agent that results in a decrease in the activation of a TGF-β receptor/kg to about 5 mg of each agent that results in a decrease in the activation of a TGF-β receptor/kg.

In some embodiments of any of the methods described herein, the subject is not diagnosed or identified as having an aging-related disease or an inflammatory disease. In some embodiments of any of the methods described herein, the subject has not been previously treated with a chemotherapeutic agent. In some embodiments of any of the methods described herein, the subject has not been previously treated with a therapeutic agent that induces cellular senescence.

Provided herein are methods of treating an aging-related disease or condition in a subject in need thereof that include administering to a subject identified as having an aging-related disease or condition a therapeutically effective amount of one or more natural killer (NK) cell activating agent(s).

Also provided herein are methods of killing or reducing the number of senescent cells in a subject in need thereof that include administering to the subject a therapeutically effective amount of one or more NK cell activating agent(s). In some embodiments of any of the methods described herein, the senescent cells are senescent cancer cells, senescent monocytes, senescent lymphocytes, senescent astrocytes, senescent microglia, senescent neurons, senescent tissue fibroblasts, senescent dermal fibroblasts, senescent keratinocytes, or other differentiated tissue-specific dividing functional cells. In some embodiments of any of the methods described herein, the senescent cancer cells are chemotherapy-induced senescent cells or radiation-induced senescent cells. In some embodiments of any of the methods described herein, the subject has been identified or diagnosed as having an aging-related disease or condition.

In some embodiments of any of the methods described herein, the aging-related disease or condition is selected from the group of: a cancer, an autoimmune disease, a metabolic disease, a neurodegenerative disease, a cardiovascular disease, a skin disease, a progeria disease, and a fragility disease. In some embodiments of any of the methods described herein, the cancer is selected from the group of: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, B-cell lymphoma, B-cell non-Hodgkin's lymphoma, Hodgkin's lymphoma, chronic lymphocytic leukemia (CLL), acute myeloid leukemia (AML), chronic myeloid leukemia (CML), acute lymphocytic leukemia (ALL), myelodysplastic syndromes (MDS), cutaneous T-cell lymphoma, retinoblastoma, stomach cancer, urothelial carcinoma, lung cancer, renal cell carcinoma, gastric and esophageal cancer, pancreatic cancer, prostate cancer, breast cancer, colorectal cancer, ovarian cancer, non-small cell lung carcinoma, squamous cell head and neck carcinoma, endometrial cancer, cervical cancer, liver cancer, and hepatocellular carcinoma.

In some embodiments of any of the methods described herein, the autoimmune disease is type-1 diabetes.

In some embodiments of any of the methods described herein, the metabolic disease is selected from the group of: obesity, a lipodystrophy, and type-2 diabetes mellitus.

In some embodiments of any of the methods described herein, the neurodegenerative disease is selected from the group of: Alzheimer's disease, Parkinson's disease, and dementia.

In some embodiments of any of the methods described herein, the cardiovascular disease is selected from the group of: coronary artery disease, atherosclerosis, and pulmonary arterial hypertension.

In some embodiments of any of the methods described herein, the skin disease is selected from the group of: wound healing, alopecia, wrinkles, senile lentigo, skin thinning, xeroderma pigmentosum, and dyskeratosis congenita.

In some embodiments of any of the methods described herein, the progeria disease is selected from the group of: progeria and Hutchinson-Gilford Progeria Syndrome.

In some embodiments of any of the methods described herein, the fragility disease is selected from the group of: frailty, responsiveness to vaccination, osteoporosis, and sarcopenia.

In some embodiments of any of the methods described herein, the aging-related disease or condition is selected from the group of: osteoarthritis, adipose atrophy, idiopathic pulmonary fibrosis, kidney transplant failure, liver fibrosis, loss of bone mass, sarcopenia, age-associated loss of lung tissue elasticity, osteoporosis, age-associated renal dysfunction, and chemical-induced renal dysfunction.

In some embodiments of any of the methods described herein, the aging-related disease or condition is type-2 diabetes or atherosclerosis.

In some embodiments of any of the methods described herein, the administering results in a decrease in the number of senescent cells in a target tissue in the subject. In some embodiments of any of the methods described herein, the target tissue is selected from the group of: adipose tissue, pancreatic tissue, liver tissue, lung tissue, vasculature, bone tissue, central nervous system (CNS) tissue, eye tissue, skin tissue, muscle tissue, and secondary lympho-organ tissue.

In some embodiments of any of the methods described herein, the administering results in an increase in the expression levels of CD25, CD69, mTORC1, SREBP1, IFN-γ, and granzyme B in activated NK cells.

Also provided herein are methods of treating an aging-related disease or condition in a subject in need thereof that include administering to a subject identified as having an aging-related disease or condition a therapeutically effective number of activated NK cells.

Also provided herein are methods of killing or reducing the number of senescent cells in a subject in need thereof that include administering to the subject a therapeutically effective number of activated NK cells. In some embodiments of any of the methods described herein, the senescent cells are senescent cancer cells, senescent monocytes, senescent lymphocytes, senescent astrocytes, senescent microglia, senescent neurons, senescent tissue fibroblasts, senescent dermal fibroblasts, senescent keratinocytes, or other differentiated tissue-specific dividing functional cells. In some embodiments of any of the methods described herein, the senescent cancer cells are chemotherapy-induced senescent cells or radiation-induced senescent cells. In some embodiments of any of the methods described herein, the subject has been identified or diagnosed as having an aging-related disease or condition.

In some embodiments of any of the methods described herein, the aging-related disease or condition is selected from the group of: a cancer, an autoimmune disease, a metabolic disease, a neurodegenerative disease, a cardiovascular disease, a skin disease, a progeria disease, and a fragility disease. In some embodiments of any of the methods described herein, the cancer is selected from the group of: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, B-cell lymphoma, B-cell non-Hodgkin's lymphoma, Hodgkin's lymphoma, chronic lymphocytic leukemia (CLL), acute myeloid leukemia (AML), chronic myeloid leukemia (CML), acute lymphocytic leukemia (ALL), myelodysplastic syndromes (MDS), cutaneous T-cell lymphoma, retinoblastoma, stomach cancer, urothelial carcinoma, lung cancer, renal cell carcinoma, gastric and esophageal cancer, pancreatic cancer, prostate cancer, breast cancer, colorectal cancer, ovarian cancer, non-small cell lung carcinoma, squamous cell head and neck carcinoma, endometrial cancer, cervical cancer, liver cancer, and hepatocellular carcinoma.

In some embodiments of any of the methods described herein, the autoimmune disease is type-1 diabetes.

In some embodiments of any of the methods described herein, the metabolic disease is selected from the group of: obesity, a lipodystrophy, and type-2 diabetes mellitus.

In some embodiments of any of the methods described herein, the neurodegenerative disease is selected from the group of: Alzheimer's disease, Parkinson's disease, and dementia.

In some embodiments of any of the methods described herein, the cardiovascular disease is selected from the group of: coronary artery disease, atherosclerosis, and pulmonary arterial hypertension.

In some embodiments of any of the methods described herein, the skin disease is selected from the group of: wound healing, alopecia, wrinkles, senile lentigo, skin thinning, xeroderma pigmentosum, and dyskeratosis congenita.

In some embodiments of any of the methods described herein, the progeria disease is selected from the group of: progeria and Hutchinson-Gilford Progeria Syndrome.

In some embodiments of any of the methods described herein, the fragility disease is selected from the group of: frailty, responsiveness to vaccination, osteoporosis, and sarcopenia.

In some embodiments of any of the methods described herein, the aging-related disease or condition is selected from the group of: age-related macular degeneration, osteoarthritis, adipose atrophy, idiopathic pulmonary fibrosis, kidney transplant failure, liver fibrosis, loss of bone mass, sarcopenia, age-associated loss of lung tissue elasticity, osteoporosis, age-associated renal dysfunction, and chemical-induced renal dysfunction.

Some embodiments of any of the methods described herein further include: obtaining a resting NK cell; and contacting the resting NK cell in vitro in a liquid culture medium including one or more NK cell activating agent(s), where the contacting results in the generation of the activated NK cells that are subsequently administered to the subject. In some embodiments of any of the methods described herein, the resting NK cell is an autologous NK cell obtained from the subject. In some embodiments of any of the methods described herein, the resting NK cell is an allogeneic resting NK cell. In some embodiments of any of the methods described herein, the resting NK cell is an artificial NK cell. In some embodiments of any of the methods described herein, the resting NK cell is a haploidentical resting NK cell. In some embodiments of any of the methods described herein, the resting NK cell is a genetically-engineered NK cell carrying a chimeric antigen receptor or recombinant T cell receptor. Some embodiments of any of the methods described herein further include isolating the activated NK cells before the activated NK cells are administered to the subject. Some embodiments of any of the methods described herein further include introducing a nucleic acid that encodes a chimeric antigen receptor or a recombinant T cell receptor into the resting NK cell or the activated NK cell prior to administration to the subject.

Also provided herein are methods of improving the texture and/or appearance of skin and/or hair in a subject in need thereof over a period of time that include administering to the subject a therapeutically effective amount of one or more natural killer (NK) cell activating agent(s).

Also provided herein are methods of improving the texture and/or appearance of skin and/or hair in a subject in need thereof over a period of time that include administering to the subject a therapeutically effective number of activated NK cells. Some embodiments of any of the methods described herein further include: obtaining a resting NK cell; and contacting the resting NK cell in vitro in a liquid culture medium including one or more NK cell activating agent(s), where the contacting results in the generation of the activated NK cells that are subsequently administered to the subject. In some embodiments of any of the methods described herein, the resting NK cell is an autologous NK cell obtained from the subject. In some embodiments of any of the methods described herein, the resting NK cell is an allogeneic resting NK cell. In some embodiments of any of the methods described herein, the resting NK cell is an artificial NK cell. In some embodiments of any of the methods described herein, the resting NK cell is a haploidentical resting NK cell. In some embodiments of any of the methods described herein, the resting NK cell is a genetically-engineered NK cell carrying a chimeric antigen receptor or recombinant T cell receptor. Some embodiments of any of the methods described herein further include isolating the activated NK cells before the activated NK cells are administered to the subject.

In some embodiments of any of the methods described herein, the method provides for an improvement in the texture and/or appearance of skin of the subject over the period of time. In some embodiments of any of the methods described herein, the method results in a decrease in the rate of formation of wrinkles in the skin of the subject over the period of time. In some embodiments of any of the methods described herein, the method results in an improvement in the coloration of skin of the subject over the period of time. In some embodiments of any of the methods described herein, the method results in a reduction of age spots on skin of the subject over the period of time. In some embodiments of any of the methods described herein, the method results in an improvement in the texture of skin of the subject over the period of time. In some embodiments of any of the methods described herein, the method provides for an improvement in the texture and/or appearance of hair of the subject over the period of time. In some embodiments of any of the methods described herein, the method results in a decrease in the rate of formation of gray hair in the subject over the period of time. In some embodiments of any of the methods described herein, the method results in a decrease in the number of gray hairs of the subject over the period of time. In some embodiments of any of the methods described herein, the method results in a decrease in the rate of hair loss in the subject over time. In some embodiments of any of the methods described herein, the method results in an improvement in the texture of hair of the subject over the period of time.

In some embodiments of any of the methods described herein, the period of time is between about one month and about 10 years. In some embodiments of any of the methods described herein, the method results in a decrease in the number of senescent dermal fibroblasts in the skin of the subject over the period of time.

Also provided herein are methods of assisting in the treatment of obesity in a subject in need thereof over a period of time that include administering to the subject a therapeutically effective amount of one or more natural killer (NK) cell activating agent(s).

Also provided herein are methods of assisting in the treatment of obesity in a subject in need thereof over a period of time that include administering to the subject a therapeutically effective number of activated NK cells. Some embodiments of any of the methods described herein further include: obtaining a resting NK cell; and contacting the resting NK cell in vitro in a liquid culture medium including one or more NK cell activating agent(s), where the contacting results in the generation of the activated NK cells that are subsequently administered to the subject. In some embodiments of any of the methods described herein, the resting NK cell is an autologous NK cell obtained from the subject. In some embodiments of any of the methods described herein, the resting NK cell is an allogeneic resting NK cell. In some embodiments of any of the methods described herein, the resting NK cell is an artificial NK cell. In some embodiments of any of the methods described herein, the resting NK cell is a haploidentical resting NK cell. In some embodiments of any of the methods described herein, the resting NK cell is a genetically-engineered NK cell carrying a chimeric antigen receptor or recombinant T cell receptor. Some embodiments of any of the methods described herein further include isolating the activated NK cells before the activated NK cells are administered to the subject.

In some embodiments of any of the methods described herein, the method results in a decrease in the mass of the subject over the period of time. In some embodiments of any of the methods described herein, the method results in a decrease in the body mass index (BMI) of the subject over the period of time. In some embodiments of any of the methods described herein, the method results in a decrease in the rate of progression from pre-diabetes to type-2 diabetes in the subject. In some embodiments of any of the methods described herein, the method results in a decrease in fasting serum glucose level in the subject. In some embodiments of any of the methods described herein, the method results in an increase in insulin sensitivity in the subject. In some embodiments of any of the methods described herein, the method results in a decrease in the severity of atherosclerosis in the subject. In some embodiments of any of the methods described herein, the period of time is between about two weeks and about 10 years.

In some embodiments of any of the methods described herein, at least one of the one or more NK cell activating agent(s) results in activation of one or more of: a receptor for IL-2, a receptor for IL-7, a receptor for IL-12, a receptor for IL-15, a receptor for IL-18, a receptor for IL-21, a receptor for IL-33, CD16, CD69, CD25, CD59, CD352, NKp80, DNAM-1, 2B4, NKp30, NKp44, NKp46, NKG2D, KIR2DS1, KIR2Ds2/3, KIR2DL4, KIR2DS4, KIR2DS5, and KIR3DS1.

In some embodiments of any of the methods described herein, the at least one of the one or more NK cell activating agent(s) that results in activation of a receptor for IL-2 is a soluble IL-2 or an agonistic antibody that binds specifically to an IL-2 receptor.

In some embodiments of any of the methods described herein, the at least one of the one or more NK cell activating agent(s) that results in activation of a receptor for IL-7 is a soluble IL-7 or an agonistic antibody that binds specifically to an IL-7 receptor.

In some embodiments of any of the methods described herein, the at least one of the one or more NK cell activating agent(s) that results in activation of a receptor for IL-12 is a soluble IL-12 or an agonistic antibody that binds specifically to an IL-12 receptor.

In some embodiments of any of the methods described herein, the at least one of the one or more NK cell activating agent(s) that results in activation of a receptor for IL-15 is a soluble IL-15 or an agonistic antibody that binds specifically to an IL-15 receptor.

In some embodiments of any of the methods described herein, the at least one of the one or more NK cell activating agent(s) that results in activation of a receptor for IL-21 is a soluble IL-21 or an agonistic antibody that binds specifically to an IL-21 receptor.

In some embodiments of any of the methods described herein, the at least one of the one or more NK cell activating agent(s) that results in activation of a receptor for IL-33 is a soluble IL-33 or an agonistic antibody that binds specifically to an IL-33 receptor.

In some embodiments of any of the methods described herein, the at least one of the one or more NK cell activating agent(s) that results in activation of a receptor for CD16 is an agonistic antibody that binds specifically to a CD16.

In some embodiments of any of the methods described herein, the at least one of the one or more NK cell activating agent(s) that results in activation of a receptor for CD69 is an agonistic antibody that binds specifically to a CD69.

In some embodiments of any of the methods described herein, the at least one of the one or more NK cell activating agent(s) that results in activation of a receptor for CD25 or CD59 is an agonistic antibody that binds specifically to CD25 or CD59.

In some embodiments of any of the methods described herein, the at least one of the one or more NK cell activating agent(s) that results in activation of a receptor for CD352 is an agonistic antibody that binds specifically to a CD352.

In some embodiments of any of the methods described herein, the at least one of the one or more NK cell activating agent(s) that results in activation of a receptor for NKp80 is an agonistic antibody that binds specifically to an NKp80.

In some embodiments of any of the methods described herein, the at least one of the one or more NK cell activating agent(s) that results in activation of a receptor for DNAM-1 is an agonistic antibody that binds specifically to a DNAM-1.

In some embodiments of any of the methods described herein, the at least one of the one or more NK cell activating agent(s) that results in activation of a receptor for 2B4 is an agonistic antibody that binds specifically to a 2B4.

In some embodiments of any of the methods described herein, the at least one of the one or more NK cell activating agent(s) that results in activation of a receptor for NKp30 is an agonistic antibody that binds specifically to an NKp30.

In some embodiments of any of the methods described herein, the at least one of the one or more NK cell activating agent(s) that results in activation of a receptor for NKp44 is an agonistic antibody that binds specifically to an NKp44.

In some embodiments of any of the methods described herein, the at least one of the one or more NK cell activating agent(s) that results in activation of a receptor for NKp46 is an agonistic antibody that binds specifically to an NKp46.

In some embodiments of any of the methods described herein, the at least one of the one or more NK cell activating agent(s) that results in activation of a receptor for NKG2D is an agonistic antibody that binds specifically to an NKG2D.

In some embodiments of any of the methods described herein, the at least one of the one or more NK cell activating agent(s) that results in activation of a receptor for KIR2DS1 is an agonistic antibody that binds specifically to a KIR2DS1.

In some embodiments of any of the methods described herein, the at least one of the one or more NK cell activating agent(s) that results in activation of a receptor for KIR2DS2/3 is an agonistic antibody that binds specifically to a KIR2DS2/3.

In some embodiments of any of the methods described herein, the at least one of the one or more NK cell activating agent(s) that results in activation of a receptor for KIR2DL4 is an agonistic antibody that binds specifically to a KIR2DL4.

In some embodiments of any of the methods described herein, the at least one of the one or more NK cell activating agent(s) that results in activation of a receptor for KIR2DS4 is an agonistic antibody that binds specifically to a KIR2DS4.

In some embodiments of any of the methods described herein, the at least one of the one or more NK cell activating agent(s) that results in activation of a receptor for KIR2DS5 is an agonistic antibody that binds specifically to a KIR2DS5.

In some embodiments of any of the methods described herein, the at least one of the one or more NK cell activating agent(s) that results in activation of a receptor for KIR3DS1 is an agonistic antibody that binds specifically to a KIR3DS1.

In some embodiments of any of the methods described herein, at least one of the one or more NK cell activating agent(s) results in a decrease in the activation of one or more of: PD-1, a TGF-β receptor, TIGIT, CD1, TIM-3, Siglec-7, IRP60, Tactile, IL1R8, NKG2A/KLRD1, KIR2DL1, KIR2DL2/3, KIR2DL5, KIR3DL1, KIR3DL2, ILT2/LIR-1, and LAG-2. In some embodiments of any of the methods described herein, the at least one of the one or more NK cell activating agent(s) that results in a decrease in the activation of PD-1 is an antagonistic antibody that binds specifically to PD-1, a soluble PD-1, a soluble PD-L1, or an antibody that binds specifically to PD-L1. In some embodiments of any of the methods described herein, at least one of the one or more NK cell activating agent(s) that results in a decrease in the activation of a TGF-β receptor is a soluble TGF-β receptor, an antibody that binds specifically to TGF-β, or an antagonistic antibody that binds specifically to a TGF-β receptor.

In some embodiments of any of the methods described herein, at least one of the one or more NK cell activating agent(s) that results in a decrease in the activation of TIGIT is an antagonistic antibody that binds specifically to TIGIT, a soluble TIGIT, or an antibody that binds specifically to a ligand of TIGIT.

In some embodiments of any of the methods described herein, at least one of the one or more NK cell activating agent(s) that results in a decrease in the activation of CD1 is an antagonistic antibody that binds specifically to CD1, a soluble CD1, or an antibody that binds specifically to a ligand of CD1.

In some embodiments of any of the methods described herein, at least one of the one or more NK cell activating agent(s) that results in a decrease in the activation of TIM-3 is an antagonistic antibody that binds specifically to TIM-3, a soluble TIM-3, or an antibody that binds specifically to a ligand of TIM-3.

In some embodiments of any of the methods described herein, at least one of the one or more NK cell activating agent(s) that results in a decrease in the activation of Siglec-7 is an antagonistic antibody that binds specifically to Siglec-7 or an antibody that binds specifically to a ligand of Siglec-7.

In some embodiments of any of the methods described herein, at least one of the one or more NK cell activating agent(s) that results in a decrease in the activation of IRP60 is an antagonistic antibody that binds specifically to IRP60 or an antibody that binds specifically to a ligand of IRP60.

In some embodiments of any of the methods described herein, at least one of the one or more NK cell activating agent(s) that results in a decrease in the activation of Tactile is an antagonistic antibody that binds specifically to Tactile or an antibody that binds specifically to a ligand of Tactile.

In some embodiments of any of the methods described herein, at least one of the one or more NK cell activating agent(s) that results in a decrease in the activation of IL is an antagonistic antibody that binds specifically to IL or an antibody that binds specifically to a ligand of IL1R8.

In some embodiments of any of the methods described herein, at least one of the one or more NK cell activating agent(s) that results in a decrease in the activation of NKG2A/KLRD1 is an antagonistic antibody that binds specifically to NKG2A/KLRD1 or an antibody that binds specifically to a ligand of NKG2A/KLRD1.

In some embodiments of any of the methods described herein, at least one of the one or more NK cell activating agent(s) that results in a decrease in the activation of KIR2DL1 is an antagonistic antibody that binds specifically to KIR2DL1 or an antibody that binds specifically to a ligand of KIR2DL1.

In some embodiments of any of the methods described herein, at least one of the one or more NK cell activating agent(s) that results in a decrease in the activation of KIR2DL2/3 is an antagonistic antibody that binds specifically to KIR2DL2/3 or an antibody that binds specifically to a ligand of KIR2DL2/3.

In some embodiments of any of the methods described herein, at least one of the one or more NK cell activating agent(s) that results in a decrease in the activation of KIR2DL5 is an antagonistic antibody that binds specifically to KIR2DL5 or an antibody that binds specifically to a ligand of KIR2DL5.

In some embodiments of any of the methods described herein, at least one of the one or more NK cell activating agent(s) that results in a decrease in the activation of KIR3DL1 is an antagonistic antibody that binds specifically to KIR3DL1 or an antibody that binds specifically to a ligand of KIR3DL1.

In some embodiments of any of the methods described herein, at least one of the one or more NK cell activating agent(s) that results in a decrease in the activation of KIR3DL2 is an antagonistic antibody that binds specifically to KIR3DL2 or an antibody that binds specifically to a ligand of KIR3DL2.

In some embodiments of any of the methods described herein, at least one of the one or more NK cell activating agent(s) that results in a decrease in the activation of ILT2/LIR-1 is an antagonistic antibody that binds specifically to ILT2/LIR-1 or an antibody that binds specifically to a ligand of ILT2/LIR-1.

In some embodiments of any of the methods described herein, at least one of the one or more NK cell activating agent(s) that results in a decrease in the activation of LAG-2 is an antagonistic antibody that binds specifically to LAG-2 or an antibody that binds specifically to a ligand of LAG-2.

In some embodiments of any of the methods described herein, at least one of the one or more NK cell activating agent(s) is a single-chain chimeric polypeptide that includes: (i) a first target-binding domain; (ii) a soluble tissue factor domain; and (iii) a second target-binding domain. In some embodiments of any of the methods described herein, the first target-binding domain and the soluble tissue factor domain directly abut each other. In some embodiments of any of the methods described herein, the single-chain chimeric polypeptide further includes a linker sequence between the first target-binding domain and the soluble tissue factor domain. In some embodiments of any of the methods described herein, the soluble tissue factor domain and the second target-binding domain directly abut each other. In some embodiments of any of the methods described herein, the single-chain chimeric polypeptide further includes a linker sequence between the soluble tissue factor domain and the second target-binding domain. In some embodiments of any of the methods described herein, the first target-binding domain and the second target-binding domain directly abut each other. In some embodiments of any of the methods described herein, the single-chain chimeric polypeptide further includes a linker sequence between the first target-binding domain and the second target-binding domain. In some embodiments of any of the methods described herein, the second target-binding domain and the soluble tissue factor domain directly abut each other. In some embodiments of any of the methods described herein, the single-chain chimeric polypeptide further includes a linker sequence between the second target-binding domain and the soluble tissue factor domain.

In some embodiments of any of the methods described herein, the first target-binding domain and the second target-binding domain bind specifically to the same antigen. In some embodiments of any of the methods described herein, the first target-binding domain and the second target-binding domain bind specifically to the same epitope. In some embodiments of any of the methods described herein, the first target-binding domain and the second target-binding domain include the same amino acid sequence.

In some embodiments of any of the methods described herein, the first target-binding domain and the second target-binding domain bind specifically to different antigens.

In some embodiments of any of the methods described herein, one or both of the first target-binding domain and the second target-binding domain is an antigen-binding domain. In some embodiments of any of the methods described herein, the first target-binding domain and the second target-binding domain are each an antigen-binding domain. In some embodiments of any of the methods described herein, the antigen-binding domain includes a scFv or a single domain antibody.

In some embodiments of any of the methods described herein, one or both of the first target-binding domain and the second target-binding domain bind to a target selected from the group of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

In some embodiments of any of the methods described herein, one or both of the first target-binding domain and the second target-binding domain is a soluble interleukin or cytokine protein. In some embodiments of any of the methods described herein, the soluble interleukin or cytokine protein is selected from the group of: IL-1, IL-2, IL-3, IL-7, IL-8, IL-10, IL-12, IL-15, IL-17, IL-18, IL-21, PDGF-DD, and SCF.

In some embodiments of any of the methods described herein, one or both of the first target-binding domain and the second target-binding domain is a soluble interleukin or cytokine receptor. In some embodiments of any of the methods described herein, the soluble interleukin or cytokine receptor is a soluble TGF-β receptor II (TGF-βRII) a soluble TGF-βRIII, a soluble receptor for TNFα, a soluble receptor for IL-4, or a soluble receptor for IL-10.

In some embodiments of any of the methods described herein, the soluble tissue factor domain is a soluble human tissue factor domain. In some embodiments of any of the methods described herein, the soluble human tissue factor domain includes a sequence that is at least 80% identical to SEQ ID NO: 93. In some embodiments of any of the methods described herein, the soluble human tissue factor domain includes a sequence that is at least 90% identical to SEQ ID NO: 93. In some embodiments of any of the methods described herein, the soluble human tissue factor domain includes a sequence that is at least 95% identical to SEQ ID NO: 93. In some embodiments of any of the methods described herein, the soluble human tissue factor domain does not include one or more of: a lysine at an amino acid position that corresponds to amino acid position 20 of mature wildtype human tissue factor protein; an isoleucine at an amino acid position that corresponds to amino acid position 22 of mature wildtype human tissue factor protein; a tryptophan at an amino acid position that corresponds to amino acid position 45 of mature wildtype human tissue factor protein; an aspartic acid at an amino acid position that corresponds to amino acid position 58 of mature wildtype human tissue factor protein; a tyrosine at an amino acid position that corresponds to amino acid position 94 of mature wildtype human tissue factor protein; an arginine at an amino acid position that corresponds to amino acid position 135 of mature wildtype human tissue factor protein; and a phenylalanine at an amino acid position that corresponds to amino acid position 140 of mature wildtype human tissue factor protein.

In some embodiments of any of the methods described herein, the soluble human tissue factor domain does not include any of: a lysine at an amino acid position that corresponds to amino acid position 20 of mature wildtype human tissue factor protein; an isoleucine at an amino acid position that corresponds to amino acid position 22 of mature wildtype human tissue factor protein; a tryptophan at an amino acid position that corresponds to amino acid position 45 of mature wildtype human tissue factor protein; an aspartic acid at an amino acid position that corresponds to amino acid position 58 of mature wildtype human tissue factor protein; a tyrosine at an amino acid position that corresponds to amino acid position 94 of mature wildtype human tissue factor protein; an arginine at an amino acid position that corresponds to amino acid position 135 of mature wildtype human tissue factor protein; and a phenylalanine at an amino acid position that corresponds to amino acid position 140 of mature wildtype human tissue factor protein.

In some embodiments of any of the methods described herein, the soluble tissue factor domain is not capable of binding Factor VIIa. In some embodiments of any of the methods described herein, the soluble tissue factor domain does not convert inactive Factor X into Factor Xa. In some embodiments of any of the methods described herein, the single-chain chimeric polypeptide does not blood stimulate coagulation in a mammal. In some embodiments of any of the methods described herein, the single-chain chimeric polypeptide further includes one or more additional target-binding domains at its N- and/or C-terminus.

In some embodiments of any of the methods described herein, the single-chain chimeric polypeptide includes one or more additional target-binding domains at its N-terminus. In some embodiments of any of the methods described herein, one or more additional target-binding domains directly abuts the first target-binding domain, the second target-binding domain, or the soluble tissue factor domain. In some embodiments of any of the methods described herein, the single-chain chimeric polypeptide further includes a linker sequence between one of the at least one additional target-binding domains and the first target-binding domain, the second target-binding domain, or the soluble tissue factor domain.

In some embodiments of any of the methods described herein, the single-chain chimeric polypeptide includes one or more additional target-binding domains at its C-terminus. In some embodiments of any of the methods described herein, one of the one or more additional target-binding domains directly abuts the first target-binding domain, the second target-binding domain, or the soluble tissue factor domain. In some embodiments of any of the methods described herein, the single-chain chimeric polypeptide further includes a linker sequence between one of the at least one additional target-binding domains and the first target-binding domain, the second target-binding domain, or the soluble tissue factor domain.

In some embodiments of any of the methods described herein, the single-chain chimeric polypeptide includes one or more additional target binding domains at its N-terminus and the C-terminus. In some embodiments of any of the methods described herein, one of the one or more additional antigen binding domains at the N-terminus directly abuts the first target-binding domain, the second target-binding domain, or the soluble tissue factor domain. In some embodiments of any of the methods described herein, the single-chain chimeric polypeptide further includes a linker sequence between one of the one or more additional antigen-binding domains at the N-terminus and the first target-binding domain, the second target-binding domain, or the soluble tissue factor domain. In some embodiments of any of the methods described herein, one of the one or more additional antigen binding domains at the C-terminus directly abuts the first target-binding domain, the second target-binding domain, or the soluble tissue factor domain. In some embodiments of any of the methods described herein, the single-chain chimeric polypeptide further includes a linker sequence between one of the one or more additional antigen-binding domains at the C-terminus and the first target-binding domain, the second target-binding domain, or the soluble tissue factor domain.

In some embodiments of any of the methods described herein, two or more of the first target-binding domain, the second target-binding domain, and the one or more additional target-binding domains bind specifically to the same antigen. In some embodiments of any of the methods described herein, two or more of the first target-binding domain, the second target-binding domain, and the one or more additional target-binding domains bind specifically to the same epitope. In some embodiments of any of the methods described herein, two or more of the first target-binding domain, the second target-binding domain, and the one or more additional target-binding domains include the same amino acid sequence. In some embodiments of any of the methods described herein, the first target-binding domain, the second target-binding domain, and the one or more additional target-binding domains each bind specifically to the same antigen. In some embodiments of any of the methods described herein, the first target-binding domain, the second target-binding domain, and the one or more additional target-binding domains each bind specifically to the same epitope. In some embodiments of any of the methods described herein, the first target-binding domain, the second target-binding domain, and the one or more additional target-binding domains each include the same amino acid sequence.

In some embodiments of any of the methods described herein, the first target-binding domain, the second target-binding domain, and the one or more additional target-binding domains bind specifically to different antigens.

In some embodiments of any of the methods described herein, one or more of the first target-binding domain, the second target-binding domain, and the one or more target-binding domains is an antigen-binding domain. In some embodiments of any of the methods described herein, the first target-binding domain, the second target-binding domain, and the one or more additional target-binding domains are each an antigen-binding domain. In some embodiments of any of the methods described herein, the antigen-binding domain includes a scFv or a single domain antibody.

In some embodiments of any of the methods described herein, one or more of the first target-binding domain, the second target-binding domain, and the one or more target-binding domains bind specifically to a target selected from the group of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

In some embodiments of any of the methods described herein, one or more of the first target-binding domain, the second target-binding domain, and the one or more additional target-binding domains is a soluble interleukin or cytokine protein. In some embodiments of any of the methods described herein, the soluble interleukin or cytokine protein is selected from the group of: IL-1, IL-2, IL-3, IL-7, IL-8, IL-10, IL-12, IL-15, IL-17, IL-18, IL-21, PDGF-DD, and SCF.

In some embodiments of any of the methods described herein, one or more of the first target-binding domain, the second target-binding domain, and the one or more additional target-binding domains is a soluble interleukin or cytokine receptor. In some embodiments of any of the methods described herein, the soluble receptor is a soluble TGF-β receptor II (TGF-βRII) a soluble TGF-βRIII, a soluble receptor for TNFα, a soluble receptor for IL-4, or a soluble receptor for IL-10.

In some embodiments of any of the methods described herein, at least one of the one or more NK cell activating agent(s) is a multi-chain chimeric polypeptide that includes: (a) a first chimeric polypeptide including: (i) a first target-binding domain; (ii) a soluble tissue factor domain; and (iii) a first domain of a pair of affinity domains; and (b) a second chimeric polypeptide including: (i) a second domain of a pair of affinity domains; and (ii) a second target-binding domain, where the first chimeric polypeptide and the second chimeric polypeptide associate through the binding of the first domain and the second domain of the pair of affinity domains.

In some embodiments of any of the methods described herein, the first target-binding domain and the soluble tissue factor domain directly abut each other in the first chimeric polypeptide. In some embodiments of any of the methods described herein, the first chimeric polypeptide further includes a linker sequence between the first target-binding domain and the soluble tissue factor domain in the first chimeric polypeptide. In some embodiments of any of the methods described herein, the soluble tissue factor domain and the first domain of the pair of affinity domains directly abut each other in the first chimeric polypeptide. In some embodiments of any of the methods described herein, the first chimeric polypeptide further includes a linker sequence between the soluble tissue factor domain and the first domain of the pair of affinity domains in the first chimeric polypeptide. In some embodiments of any of the methods described herein, the second domain of the pair of affinity domains and the second target-binding domain directly abut each other in the second chimeric polypeptide. In some embodiments of any of the methods described herein, the second chimeric polypeptide further includes a linker sequence between the second domain of the pair of affinity domains and the second target-binding domain in the second chimeric polypeptide.

In some embodiments of any of the methods described herein, the first target-binding domain and the second target-binding domain bind specifically to the same antigen. In some embodiments of any of the methods described herein, the first target-binding domain and the second target-binding domain bind specifically to the same epitope. In some embodiments of any of the methods described herein, the first target-binding domain and the second target-binding domain include the same amino acid sequence.

In some embodiments of any of the methods described herein, the first target-binding domain and the second target-binding domain bind specifically to different antigens.

In some embodiments of any of the methods described herein, one or both of the first target-binding domain and the second target-binding domain is an antigen-binding domain. In some embodiments of any of the methods described herein, the first target-binding domain and the second target-binding domain are each antigen-binding domains. In some embodiments of any of the methods described herein, the antigen-binding domain includes a scFv or a single domain antibody.

In some embodiments of any of the methods described herein, one or both of the first target-binding domain and the second target-binding domain bind specifically to a target selected from the group of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

In some embodiments of any of the methods described herein, one or both of the first target-binding domain and the second target-binding domain is a soluble interleukin or cytokine protein. In some embodiments of any of the methods described herein, the soluble interleukin or cytokine protein is selected from the group of: IL-1, IL-2, IL-3, IL-7, IL-8, IL-10, IL-12, IL-15, IL-17, IL-18, IL-21, PDGF-DD, and SCF.

In some embodiments of any of the methods described herein, one or both of the first target-binding domain and the second target-binding domain is a soluble interleukin or cytokine receptor. In some embodiments of any of the methods described herein, the soluble receptor is a soluble TGF-β receptor II (TGF-βRII) a soluble TGF-βRIII, a soluble receptor for TNFα, a soluble receptor for IL-4, or a soluble receptor for IL-10.

In some embodiments of any of the methods described herein, the first chimeric polypeptide further includes one or more additional target-binding domain(s), where at least one of the one or more additional antigen-binding domain(s) is positioned between the soluble tissue factor domain and the first domain of the pair of affinity domains. In some embodiments of any of the methods described herein, the first chimeric polypeptide further includes a linker sequence between the soluble tissue factor domain and the at least one of the one or more additional antigen-binding domain(s), and/or a linker sequence between the at least one of the one or more additional antigen-binding domain(s) and the first domain of the pair of affinity domains.

In some embodiments of any of the methods described herein, the first chimeric polypeptide further includes one or more additional target-binding domains at the N-terminal and/or C-terminal end of the first chimeric polypeptide. In some embodiments of any of the methods described herein, at least one of the one or more additional target-binding domains directly abuts the first domain of the pair of affinity domains in the first chimeric polypeptide. In some embodiments of any of the methods described herein, the first chimeric polypeptide further includes a linker sequence between the at least one of the one or more additional target-binding domains and the first domain of the pair of affinity domains. In some embodiments of any of the methods described herein, the at least one of the one or more additional target-binding domains directly abuts the first target-binding domain in the first chimeric polypeptide. In some embodiments of any of the methods described herein, the first chimeric polypeptide further includes a linker sequence between the at least one of the one or more additional target-binding domains and the first target-binding domain.

In some embodiments of any of the methods described herein, at least one of the one or more additional target-binding domains is disposed at the N- and/or C-terminus of the first chimeric polypeptide, and at least one of the one or more additional target-binding domains is positioned between the soluble tissue factor domain and the first domain of the pair of affinity domains in the first chimeric polypeptide. In some embodiments of any of the methods described herein, the at least one additional target-binding domain of the one or more additional target-binding domains disposed at the N-terminus directly abuts the first target-binding domain or the first domain of the pair of affinity domains in the first chimeric polypeptide. In some embodiments of any of the methods described herein, the first chimeric polypeptide further includes a linker sequence disposed between the at least one additional target-binding domain and the first target-binding domain or the first domain of the pair of affinity domains in the first chimeric polypeptide. In some embodiments of any of the methods described herein, the at least one additional target-binding domain of the one or more additional target-binding domains disposed at the C-terminus directly abuts the first target-binding domain or the first domain of the pair of affinity domains in the first chimeric polypeptide. In some embodiments of any of the methods described herein, the first chimeric polypeptide further includes a linker sequence disposed between the at least one additional target-binding domain and the first target-binding domain or the first domain of the pair of affinity domains in the first chimeric polypeptide. In some embodiments of any of the methods described herein, the at least one of the one or more additional target-binding domains positioned between the soluble tissue factor domain and the first domain of the pair of affinity domains, directly abuts the soluble tissue factor domain and/or the first domain of the pair of affinity domains. In some embodiments of any of the methods described herein, the first chimeric polypeptide further includes a linker sequence disposed (i) between the soluble tissue factor domain and the at least one of the one or more additional target-binding domains positioned between the soluble tissue factor domain and the first domain of the pair of affinity domains, and/or (ii) between the first domain of the pair of affinity domains and the at least one of the one or more additional target-binding domains positioned between the soluble tissue factor domain and the first domain of the pair of affinity domains.

In some embodiments of any of the methods described herein, the second chimeric polypeptide further includes one or more additional target-binding domains at the N-terminal end or the C-terminal end of the second chimeric polypeptide. In some embodiments of any of the methods described herein, at least one of the one or more additional target-binding domains directly abuts the second domain of the pair of affinity domains in the second chimeric polypeptide. In some embodiments of any of the methods described herein, the second chimeric polypeptide further includes a linker sequence between at least one of the one or more additional target-binding domains and the second domain of the pair of affinity domains in the second chimeric polypeptide. In some embodiments of any of the methods described herein, at least one of the one or more additional target-binding domains directly abuts the second target-binding domain in the second chimeric polypeptide. In some embodiments of any of the methods described herein, the second chimeric polypeptide further includes a linker sequence between at least one of the one or more additional target-binding domains and the second target-binding domain in the second chimeric polypeptide.

In some embodiments of any of the methods described herein, two or more of the first target-binding domain, the second target-binding domain, and the one or more additional target-binding domains bind specifically to the same antigen. In some embodiments of any of the methods described herein, two or more of the first target-binding domain, the second target-binding domain, and the one or more additional target-binding domains bind specifically to the same epitope. In some embodiments of any of the methods described herein, two or more of the first target-binding domain, the second target-binding domain, and the one or more additional target-binding domains include the same amino acid sequence. In some embodiments of any of the methods described herein, the first target-binding domain, the second target-binding domain, and the one or more additional target-binding domains each bind specifically to the same antigen. In some embodiments of any of the methods described herein, the first target-binding domain, the second target-binding domain, and the one or more additional target-binding domains each bind specifically to the same epitope. In some embodiments of any of the methods described herein, the first target-binding domain, the second target-binding domain, and the one or more additional target-binding domains each include the same amino acid sequence.

In some embodiments of any of the methods described herein, the first target-binding domain, the second target-binding domain, and the one or more additional target-binding domains bind specifically to different antigens. In some embodiments of any of the methods described herein, one or more of the first target-binding domain, the second target-binding domain, and the one or more target-binding domains is an antigen-binding domain. In some embodiments of any of the methods described herein, the first target-binding domain, the second target-binding domain, and the one or more additional target-binding domains are each an antigen-binding domain. In some embodiments of any of the methods described herein, the antigen-binding domain includes a scFv.

In some embodiments of any of the methods described herein, one or more of the first target-binding domain, the second target-binding domain, and the one or more target-binding domains bind specifically to a target selected from the group of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

In some embodiments of any of the methods described herein, one or more of the first target-binding domain, the second target-binding domain, and the one or more additional target-binding domains is a soluble interleukin or cytokine protein. In some embodiments of any of the methods described herein, the soluble interleukin or cytokine protein is selected from the group of: IL-1, IL-2, IL-3, IL-7, IL-8, IL-10, IL-12, IL-15, IL-17, IL-18, IL-21, PDGF-DD, and SCF.

In some embodiments of any of the methods described herein, one or more of the first target-binding domain, the second target-binding domain, and the one or more additional target-binding domains is a soluble interleukin or cytokine receptor. In some embodiments of any of the methods described herein, the soluble receptor a soluble TGF-β receptor II (TGF-βRII) a soluble TGF-βRIII, a soluble receptor for TNFα, a soluble receptor for IL-4, or a soluble receptor for IL-10.

In some embodiments of any of the methods described herein, the soluble tissue factor domain is a soluble human tissue factor domain. In some embodiments of any of the methods described herein, the soluble human tissue factor domain includes a sequence that is at least 80% identical to SEQ ID NO: 93. In some embodiments of any of the methods described herein, the soluble human tissue factor domain includes a sequence that is at least 90% identical to SEQ ID NO: 93. In some embodiments of any of the methods described herein, the soluble human tissue factor domain includes a sequence that is at least 95% identical to SEQ ID NO: 93.

In some embodiments of any of the methods described herein, the soluble human tissue factor domain does not include one or more of: a lysine at an amino acid position that corresponds to amino acid position 20 of mature wildtype human tissue factor protein; an isoleucine at an amino acid position that corresponds to amino acid position 22 of mature wildtype human tissue factor protein; a tryptophan at an amino acid position that corresponds to amino acid position 45 of mature wildtype human tissue factor protein; an aspartic acid at an amino acid position that corresponds to amino acid position 58 of mature wildtype human tissue factor protein; a tyrosine at an amino acid position that corresponds to amino acid position 94 of mature wildtype human tissue factor protein; an arginine at an amino acid position that corresponds to amino acid position 135 of mature wildtype human tissue factor protein; and a phenylalanine at an amino acid position that corresponds to amino acid position 140 of mature wildtype human tissue factor protein.

In some embodiments of any of the methods described herein, the soluble human tissue factor domain does not include any of: a lysine at an amino acid position that corresponds to amino acid position 20 of mature wildtype human tissue factor protein; an isoleucine at an amino acid position that corresponds to amino acid position 22 of mature wildtype human tissue factor protein; a tryptophan at an amino acid position that corresponds to amino acid position 45 of mature wildtype human tissue factor protein; an aspartic acid at an amino acid position that corresponds to amino acid position 58 of mature wildtype human tissue factor protein; a tyrosine at an amino acid position that corresponds to amino acid position 94 of mature wildtype human tissue factor protein; an arginine at an amino acid position that corresponds to amino acid position 135 of mature wildtype human tissue factor protein; and a phenylalanine at an amino acid position that corresponds to amino acid position 140 of mature wildtype human tissue factor protein.

In some embodiments of any of the methods described herein, the soluble tissue factor domain is not capable of binding to Factor VIIa. In some embodiments of any of the methods described herein, the soluble tissue factor domain does not convert inactive Factor X into Factor Xa. In some embodiments of any of the methods described herein, the multi-chain chimeric polypeptide does not stimulate blood coagulation in a mammal. In some embodiments of any of the methods described herein, the pair of affinity domains is a sushi domain from an alpha chain of human IL-15 receptor (IL-15Rα) and a soluble IL-15. In some embodiments of any of the methods described herein, the soluble IL-15 has a D8N or D8A amino acid substitution. In some embodiments of any of the methods described herein, the human IL-15Rα is a mature full-length IL-15Rα.

In some embodiments of any of the methods described herein, the pair of affinity domains is selected from the group of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25.

In some embodiments of any of the methods described herein, at least one of the one or more NK cell activating agent(s) is a multi-chain chimeric polypeptide that includes: (a) a first and second chimeric polypeptides, where each includes: (i) a first target-binding domain; (ii) a Fc domain; and (iii) a first domain of a pair of affinity domains; and (b) a third and fourth chimeric polypeptide, where each includes: (i) a second domain of a pair of affinity domains; and (ii) a second target-binding domain, where the first and second chimeric polypeptides and the third and fourth chimeric polypeptides associate through the binding of the first domain and the second domain of the pair of affinity domains, and the first and second chimeric polypeptides associate through their Fc domains.

In some embodiments of any of the methods described herein, the first target-binding domain and the Fc domain directly abut each other in the first and second chimeric polypeptides. In some embodiments of any of the methods described herein, the first and second chimeric polypeptides further include a linker sequence between the first target-binding domain and the Fc domain in the first and second chimeric polypeptides. In some embodiments of any of the methods described herein, the Fc domain and the first domain of the pair of affinity domains directly abut each other in the first and second chimeric polypeptides. In some embodiments of any of the methods described herein, the first chimeric polypeptide further includes a linker sequence between the Fc domain and the first domain of the pair of affinity domains in the first and second chimeric polypeptides.

In some embodiments of any of the methods described herein, the second domain of the pair of affinity domains and the second target-binding domain directly abut each other in the third and fourth chimeric polypeptides. In some embodiments of any of the methods described herein, the third and fourth chimeric polypeptides further include a linker sequence between the second domain of the pair of affinity domains and the second target-binding domain in the third and fourth chimeric polypeptides.

In some embodiments of any of the methods described herein, the first target-binding domain and the second target-binding domain bind specifically to the same antigen. In some embodiments of any of the methods described herein, the first target-binding domain and the second target-binding domain bind specifically to the same epitope. In some embodiments of any of the methods described herein, the first target-binding domain and the second target-binding domain include the same amino acid sequence.

In some embodiments of any of the methods described herein, the first target-binding domain and the second target-binding domain bind specifically to different antigens. In some embodiments of any of the methods described herein, one or both of the first target-binding domain and the second target-binding domain is an antigen-binding domain. In some embodiments of any of the methods described herein, the first target-binding domain and the second target-binding domain are each antigen-binding domains. In some embodiments of any of the methods described herein, the antigen-binding domain includes a scFv or a single domain antibody.

In some embodiments of any of the methods described herein, one or both of the first target-binding domain and the second target-binding domain bind specifically to a target selected from the group of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

In some embodiments of any of the methods described herein, one or both of the first target-binding domain and the second target-binding domain is a soluble interleukin or cytokine protein. In some embodiments of any of the methods described herein, the soluble interleukin or cytokine protein is selected from the group of: IL-1, IL-2, IL-3, IL-7, IL-8, IL-10, IL-12, IL-15, IL-17, IL-18, IL-21, PDGF-DD, and SCF.

In some embodiments of any of the methods described herein, one or both of the first target-binding domain and the second target-binding domain is a soluble interleukin or cytokine receptor. In some embodiments of any of the methods described herein, the soluble receptor is a soluble TGF-β receptor II (TGF-βRII) a soluble TGF-βRIII, a soluble receptor for TNFα, a soluble receptor for IL-4, or a soluble receptor for IL-10.

In some embodiments of any of the methods described herein, the soluble tissue factor domain is a soluble human tissue factor domain that does not stimulate blood coagulation. In some embodiments of any of the methods described herein, the soluble tissue factor domain comprises or consists of a sequence from a wildtype soluble human tissue factor.

Provided herein are methods of killing or reducing the number of naturally-occurring and/or treatment-induced senescent cells in a subject that include administering to the subject a therapeutically effective amount of one or more common gamma-chain family cytokine receptor activating agent(s).

Also provided herein are methods of decreasing the accumulation of naturally-occurring and/or treatment-induced senescent cells in a subject that include administering to the subject a therapeutically effective amount of one or more common gamma-chain family cytokine receptor activating agent(s).

Also provided herein are methods of decreasing a level of a marker of naturally-occurring and/or treatment-induced senescent cells in a subject that include administering to the subject a therapeutically effective amount of one or more common gamma-chain family cytokine receptor activating agent(s).

Also provided herein are methods of reducing the activity of naturally-occurring and/or treatment-induced senescent cells in a subject that include administering to the subject a therapeutically effective amount of one or more common gamma-chain family cytokine receptor activating agent(s).

Also provided herein are methods of decreasing levels and/or activity of one or more SASP factor(s) derived from naturally-occurring and/or treatment-induced senescent cells in a subject that include administering to the subject a therapeutically effective amount of one or more common gamma-chain family cytokine receptor activating agent(s).

In some embodiments, the subject has been previously diagnosed or identified as having an aging-related disease or an inflammatory disease. In some embodiments, the aging-related disease is inflamm-aging related.

In some embodiments, the aging-related disease is selected from the group of: Alzheimer's disease, aneurysm, cystic fibrosis, fibrosis in pancreatitis, glaucoma, hypertension, idiopathic pulmonary fibrosis, inflammatory bowel disease, intervertebral disc degeneration, osteoarthritis, type 2 diabetes mellitus, adipose atrophy, lipodystrophy, atherosclerosis, cataracts, COPD, kidney transplant failure, liver fibrosis, loss of bone mass, myocardial infarction, sarcopenia, wound healing, alopecia, cardiomyocyte hypertrophy, osteoarthritis, Parkinson's disease, age-associated loss of lung tissue elasticity, age-related macular degeneration, cachexia, glomerulosclerosis, liver cirrhosis, NAFLD, osteoporosis, amyotrophic lateral sclerosis, Huntington's disease, spinocerebellar ataxia, multiple sclerosis, neurodegeneration, stroke, cancer, dementia, vascular disease, infection susceptibility, chronic inflammation, and renal dysfunction.

In some embodiments, the aging-related disease is a cancer selected from the group of: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, B-cell lymphoma, B-cell non-Hodgkin's lymphoma, Hodgkin's lymphoma, chronic lymphocytic leukemia (CLL), acute myeloid leukemia (AML), chronic myeloid leukemia (CML), acute lymphocytic leukemia (ALL), myelodysplastic syndromes (MDS), cutaneous T-cell lymphoma, retinoblastoma, stomach cancer, urothelial carcinoma, lung cancer, renal cell carcinoma, gastric and esophageal cancer, pancreatic cancer, prostate cancer, breast cancer, colorectal cancer, ovarian cancer, non-small cell lung carcinoma, squamous cell head and neck carcinoma, endometrial cancer, cervical cancer, liver cancer, and hepatocellular carcinoma.

In some embodiments, the inflammatory disease is selected from the group of: rheumatoid arthritis, inflammatory bowel disease, lupus erythematosus, lupus nephritis, diabetic nephropathy, CNS injury, Alzheimer's disease, Parkinson's disease, amyotrophic lateral sclerosis, Crohn's disease, multiple sclerosis, Guillain-Barre syndrome, psoriasis, Grave's disease, ulcerative colitis, nonalcoholic steatohepatitis, mood disorders and cancer treatment-related cognitive impairment.

In some embodiments, the treatment-induced senescent cells are chemotherapy-induced senescent cells. In some embodiments, the administration of the one or more common gamma-chain family cytokine receptor activating agent(s) results in a decrease in the number of naturally-occurring senescent cells and/or treatment-induced senescent cells in a target tissue in the subject. In some embodiments, the target tissue is selected from the group of: adipose tissue, pancreatic tissue, liver tissue, kidney tissue, lung tissue, vasculature, bone tissue, central nervous system (CNS) tissue, eye tissue, skin tissue, muscle tissue, and secondary lympho-organ tissue.

In some embodiments, at least one of the one or more common gamma-chain family cytokine receptor activating agent(s) is a complex of a common gamma-chain family cytokine or a functional fragment thereof and an antibody or antibody fragment that binds specifically to the common gamma-chain family cytokine or the functional fragment thereof.

In some embodiments, at least one of the one or more common gamma-chain family cytokine receptor activating agent(s) is a single-chain chimeric polypeptide comprising: (i) a first target-binding domain; (ii) a soluble tissue factor domain; and (iii) a second target-binding domain, wherein one or both of the first target-binding domain and the second target-binding domain is a soluble common gamma-chain family cytokine, an agonistic antigen-binding domain that binds specifically to a common gamma-chain family cytokine receptor, a soluble common gamma-chain family cytokine receptor, or an antigen-binding domain that binds specifically to a common gamma-chain family cytokine.

In some embodiments, one or both of the first target-binding domain and the second target-binding domain comprises a soluble common gamma-chain family cytokine. In some embodiments, the soluble common gamma-chain family cytokine is selected from the group consisting of: soluble IL-2, soluble IL-4, soluble IL-7, soluble IL-9, soluble IL-15, and soluble IL-21. In some embodiments, one or both of the first target-binding domain and the second target-binding domain comprises an agonistic antigen-binding domain that binds specifically to a common gamma-chain family cytokine receptor. In some embodiments, the common gamma-chain family cytokine receptor is a receptor for one or more of IL-2, IL-4, IL-7, IL-9, IL-15, and IL-21. In some embodiments, the agonistic antigen-binding domain is an scFv, a VHH, or a VNAR.

In some embodiments, the first target-binding domain and the soluble tissue factor domain directly abut each other. In some embodiments, the single-chain chimeric polypeptide further comprises a linker sequence between the first target-binding domain and the soluble tissue factor domain. In some embodiments, the soluble tissue factor domain and the second target-binding domain directly abut each other. In some embodiments, the single-chain chimeric polypeptide further comprises a linker sequence between the soluble tissue factor domain and the second target-binding domain. In some embodiments, the first target-binding domain and the second target-binding domain bind specifically to the same antigen. In some embodiments, the first target-binding domain and the second target-binding domain bind specifically to the same epitope. In some embodiments, the first target-binding domain and the second target-binding domain comprise the same amino acid sequence. In some embodiments, the first target-binding domain and the second target-binding domain bind specifically to different antigens.

In some embodiments, the soluble tissue factor domain is a soluble human tissue factor domain. In some embodiments, the soluble human tissue factor domain comprises a sequence that is at least 80% identical to SEQ ID NO: 93. In some embodiments, the single-chain chimeric polypeptide further comprises one or more additional target-binding domains at its N- and/or C-terminus.

In some embodiments, at least one of the one or more common gamma-chain family cytokine receptor activating agent(s) is a multi-chain chimeric polypeptide comprising: (a) a first chimeric polypeptide comprising: (i) a first target-binding domain; (ii) a soluble tissue factor domain; and (iii) a first domain of a pair of affinity domains; (b) a second chimeric polypeptide comprising: (i) a second domain of a pair of affinity domains; and (ii) a second target-binding domain, wherein one or both of the first target-binding domain and the second target-binding domain is a soluble common gamma-chain family cytokine, an agonistic antigen-binding domain that binds specifically to a common gamma-chain family cytokine receptor, a soluble common gamma-chain family cytokine receptor, or an antigen-binding domain that binds specifically to a common gamma-chain family cytokine.

In some embodiments, one or both of the first target-binding domain and the second target-binding domain comprises a soluble common gamma-chain family cytokine. In some embodiments, the soluble common gamma-chain family cytokine is selected from the group of: soluble IL-2, soluble IL-4, soluble IL-7, soluble IL-9, soluble IL-15, and soluble IL-21. In some embodiments, one or both of the first target-binding domain and the second target-binding domain comprises an agonistic antigen-binding domain that binds specifically to a common gamma-chain family cytokine receptor. In some embodiments, the common gamma-chain family cytokine receptor is a receptor for one or more of IL-2, IL-4, IL-7, IL-9, IL-15, and IL-21. In some embodiments, the agonistic antigen-binding domain is an scFv, a VHH, or a VNAR.

In some embodiments, the first target-binding domain and the soluble tissue factor domain directly abut each other in the first chimeric polypeptide. In some embodiments, the first chimeric polypeptide further comprises a linker sequence between the first target-binding domain and the soluble tissue factor domain in the first chimeric polypeptide. In some embodiments, the soluble tissue factor domain and the first domain of the pair of affinity domains directly abut each other in the first chimeric polypeptide. In some embodiments, the first chimeric polypeptide further comprises a linker sequence between the soluble tissue factor domain and the first domain of the pair of affinity domains in the first chimeric polypeptide. In some embodiments, the second domain of the pair of affinity domains and the second target-binding domain directly abut each other in the second chimeric polypeptide. In some embodiments, the second chimeric polypeptide further comprises a linker sequence between the second domain of the pair of affinity domains and the second target-binding domain in the second chimeric polypeptide.

In some embodiments, the first target-binding domain and the second target-binding domain bind specifically to the same antigen. In some embodiments, the first target-binding domain and the second target-binding domain bind specifically to different antigens. In some embodiments, the first chimeric polypeptide further comprises one or more additional target-binding domain(s). In some embodiments, the second chimeric polypeptide further comprises one or more additional target-binding domains.

In some embodiments, the soluble tissue factor domain is a soluble human tissue factor domain. In some embodiments, the soluble human tissue factor domain comprises a sequence that is at least 80% identical to SEQ ID NO: 93. In some embodiments, the pair of affinity domains is a sushi domain from an alpha chain of human IL-15 receptor (IL15Rα) and a soluble IL-15. In some embodiments, the pair of affinity domains is selected from the group of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25.

In some embodiments, the first domain or the second domain of a pair of affinity domains is a soluble common gamma-chain family cytokine or an antigen-binding domain that binds specifically to a common gamma-chain family cytokine receptor. In some embodiments, at least one of the one or more common gamma-chain family cytokine receptor activating agent(s) is soluble IL-15 or an IL-15 agonist. In some embodiments, the soluble IL-15 is at least 90% identical to SEQ ID NO: 82. In some embodiments, the IL-15 agonist comprises a complex of IL-15 and all or a portion of a soluble IL-15 receptor (IL-15R). In some embodiments, the portion of the soluble IL-15R is a portion of IL-15Rα. In some embodiments, the portion of the soluble IL-15Rα is a sushi domain of IL-15Rα. In some embodiments, the IL-15 agonist further comprises an Fc domain. In some embodiments, the IL-15 agonist comprises a fusion protein comprising IL-15 and a sushi domain from an IL-15Rα. In some embodiments, one of the one or more common gamma-chain family cytokine receptor activating agent(s) is a soluble IL-2 or an IL-2 agonist. In some embodiments, one of the one or more common gamma-chain family cytokine receptor activating agent(s) is an antibody or an antigen-binding antibody fragment that binds specifically to a common gamma-chain family cytokine.

In some embodiments, the method comprises administering one, two or more doses of the one or more common gamma-chain family cytokine receptor activating agent(s) to the subject. In some embodiments, any two consecutive doses of the two or more doses are administered about 1 week to about one year apart. In some embodiments, any two consecutive doses of the two or more doses are administered about 1 week to about 6 months apart. In some embodiments, any two consecutive doses of the two or more doses are administered about 1 week to about 2 months apart. In some embodiments, any two consecutive doses of the two or more doses are administered about 1 week to about 1 month apart.

In some embodiments, the one, two or more doses are administered by subcutaneous administration. In some embodiments, the two or more doses are administered by intramuscular administration. In some embodiments, the two or more doses are administered over a period of time of about 1 year to about 60 years. In some embodiments, the two or more doses are administered over a period of time of about 1 year to about 50 years. In some embodiments, the two or more doses are administered over a period of time of about 1 year to about 40 years. In some embodiments, the two or more doses are administered over a period of time of about 1 year to about 30 years. In some embodiments, the two or more doses are administered over a period of time of about 1 year to about 20 years. In some embodiments, the two or more doses are administered over a period of time of about 1 year to about 10 years.

In some embodiments, each of the two or more doses are administered at a dosage of about 0.01 mg of each common gamma-chain family cytokine receptor activating agent/kg to about 10 mg of each common gamma-chain family cytokine receptor activating agent/kg. In some embodiments, each of the two or more doses are administered at a dosage of about 0.02 mg of each common gamma-chain family cytokine receptor activating agent/kg to about 5 mg of each common gamma-chain family cytokine receptor activating agent/kg.

In some embodiments, a first dose of the one or more common gamma-chain family cytokine receptor activating agent(s) begins when the subject reaches an age of at least 30 years. In some embodiments, a first dose of the one or more common gamma-chain family cytokine receptor activating agent(s) begins when the subject reaches an age of at least 40 years. In some embodiments, a first dose of the one or more common gamma-chain family cytokine receptor activating agent(s) begins when the subject reaches an age of at least 50 years. In some embodiments, a first dose of the one or more common gamma-chain family cytokine receptor activating agent(s) begins when the subject reaches an age of at least 60 years.

In some embodiments, the subject is not diagnosed or identified as having an aging-related disease or an inflammatory disease. In some embodiments, the subject has not been previously treated with a chemotherapeutic agent. In some embodiments, the subject has not been previously treated with a therapeutic agent that induces cellular senescence. In some embodiments, the method further comprises administering to the subject at least one or more agent(s) that results in a decrease in the activation of a TGF-β receptor. In some embodiments, the agent that results in a decrease in the activation of a TGF-β receptor is a soluble TGF-β receptor, an extracellular domain of TGF-β receptor, an antibody that binds specifically to TGF-β, an antagonistic antibody that binds to a TGF-β receptor, an agent that binds to a LAP, or an agent that binds to a TGF-β/LAP complex. In some embodiments, the one or more agent(s) that result(s) in a decrease in the activation of a TGF-β decrease(s) the activation of a TGF-β receptor through binding to a LAP, or to a TGF-β/LAP complex.

In some embodiments, the soluble human tissue factor domain does not initiate blood coagulation. In some embodiments, the method further comprises administering an additional therapeutic agent selected from the group of: combinations of agents, such as checkpoint inhibitors, chemotherapy drugs, and therapeutic antibodies.

In some embodiments of any of the methods described herein, the single-chain chimeric polypeptide is stable in human serum for at least 10 days at 37° C. In some embodiments of any of the methods described herein, the multi-chain chimeric polypeptide is stable in human serum for at least 10 days at 37° C. In some embodiments of any of the methods described herein, the single-chain chimeric polypeptide does not have significant clotting activity. In some embodiments of any of the methods described herein, the multi-chain chimeric polypeptide does not have significant clotting activity.

In some embodiments of any of the methods described herein, the method results in rejuvenation of aged immune cells in the subject. In some embodiments of any of the methods described herein, the rejuvenation of the aged immune cells results in a reduction of number of diseased cells or infectious agents in the subject. In some embodiments of any of the methods described herein, the aged immune cells include one or more of aged NK cells, aged NKT cells, aged T cells, aged B cells, aged monocytes, aged macrophages, aged neutrophils, aged basophils, aged eosinophils, aged Kupffer cells, and aged microgial cells. In some embodiments of any of the methods described herein, the diseased cells include cancer cells, virally-infected cells, and intracellularly-bacterially-infected cells. In some embodiments of any of the methods described herein, the infectious agents include virus, bacterium, fungus, and parasite.

As used herein, the term "chimeric" refers to a polypeptide that includes amino acid sequences (e.g., domains) originally derived from two different sources (e.g., two different naturally-occurring proteins, e.g., from the same or different species). For example, a chimeric polypeptide can include domains from at least two different naturally occurring human proteins. In some examples, a chimeric polypeptide can include a domain that is a synthetic sequence (e.g., a scFv) and a domain that is derived from a naturally-occurring protein (e.g., a naturally-occurring human protein). In some embodiments, a chimeric polypeptide can include at least two different domains that are synthetic sequences (e.g., two different scFvs).

An "activated NK cell" is a NK cell demonstrating increased expression levels of two or more (e.g., three, four, five, or six) of CD25, CD69, MTOR-C1, SREBP, IFN-γ, and a granzyme (e.g., granzyme B), e.g., as compared to a resting NK cell. Exemplary methods for identifying the expression levels of CD25, CD69, MTOR-C1, SREBP, IFN-γ, and a granzyme (e.g., granzyme B) are described herein.

A "resting NK cell" is a NK cell that has a reduced expression of two or more (e.g., three, four, five, or six) of CD25, CD69, MTOR-C1, SREBP, IFN-γ, and a granzyme (e.g., granzyme B), e.g., as compared to an activated NK cell.

An "NK cell activating agent" is an agent that induces or promotes (alone or in combination with additional NK cell activating agents) a resting NK cell to develop into an activated NK cell. Non-limiting examples and aspects of NK cell activating agents are described herein.

An "antigen-binding domain" is one or more protein domain(s) (e.g., formed from amino acids from a single polypeptide or formed from amino acids from two or more polypeptides (e.g., the same or different polypeptides) that is capable of specifically binding to one or more different antigen(s). In some examples, an antigen-binding domain can bind to an antigen or epitope with specificity and affinity similar to that of naturally-occurring antibodies. In some embodiments, the antigen-binding domain can be an antibody or a fragment thereof. In some embodiments, an antigen-binding domain can include an alternative scaffold. Non-limiting examples of antigen-binding domains are described herein. Additional examples of antigen-binding domains are known in the art.

A "soluble tissue factor domain" refers to a polypeptide having at least 70% identity (e.g., at least 75% identity, at least 80% identity, at least 85% identity, at least 90% identity, at least 95% identity, at least 99% identity, or 100% identical) to a segment of a wildtype mammalian tissue factor protein (e.g., a wildtype human tissue factor protein) that lacks the transmembrane domain and the intracellular domain. Non-limiting examples of soluble tissue factor domains are described herein.

The term "soluble interleukin protein" is used herein to refer to a mature and secreted interleukin protein or a biologically active fragment thereof. In some examples, a soluble interleukin protein can include a sequence that is at least 70% identical, at least 75% identical, at least 80% identical, at least 85% identical, at least 90% identical, at least 95% identical, at least 99% identical, or 100% identical to a wildtype mature and secreted mammalian interleukin protein (e.g., a wildtype human interleukin protein) and retains its biological activity. Non-limiting examples of soluble interleukin proteins are described herein.

The term "soluble cytokine protein" is used herein to refer to a mature and secreted cytokine protein or a biologically active fragment thereof. In some examples, a soluble cytokine protein can include a sequence that is at least 70% identical, at least 75% identical, at least 80% identical, at least 85% identical, at least 90% identical, at least 95% identical, at least 99% identical, or 100% identical to a wildtype mature and secreted mammalian interleukin protein (e.g., a wildtype human interleukin protein) and retains its biological activity. Non-limiting examples of soluble cytokine proteins are described herein.

The term "soluble interleukin receptor" is used herein in the broadest sense to refer to a polypeptide that lacks a transmembrane domain (and optionally an intracellular domain) that is capable of binding one or more of its natural ligands (e.g., under physiological conditions, e.g., in phosphate buffered saline at room temperature). For example, a soluble interleukin receptor can include a sequence that is at least 70% identical (e.g., at least 75% identical, at least 80% identical, at least 85% identical, at least 90% identical, at least 95% identical, at least 99% identical, or 100% identical) to an extracellular domain of wildtype interleukin receptor and retains its ability to specifically bind to one or more of its natural ligands, but lacks its transmembrane domain (and optionally, further lacks its intracellular domain). Non-limiting examples of soluble interleukin receptors are described herein.

The term "soluble cytokine receptor" is used herein in the broadest sense to refer to a polypeptide that lacks a transmembrane domain (and optionally an intracellular domain) that is capable of binding one or more of its natural ligands (e.g., under physiological conditions, e.g., in phosphate buffered saline at room temperature). For example, a soluble cytokine receptor can include a sequence that is at least 70% identical (e.g., at least 75% identical, at least 80% identical, at least 85% identical, at least 90% identical, at least 95% identical, at least 99% identical, or 100% identical) to an extracellular domain of wildtype cytokine receptor and retains its ability to specifically bind to one or more of its natural ligands, but lacks its transmembrane domain (and optionally, further lacks its intracellular domain). Non-limiting examples of soluble cytokine receptors are described herein.

The term "antibody" is used herein in its broadest sense and includes certain types of immunoglobulin molecules that include one or more antigen-binding domains that specifically bind to an antigen or epitope. An antibody specifically includes, e.g., intact antibodies (e.g., intact immunoglobulins), antibody fragments, and multi-specific antibodies. One example of an antigen-binding domain is an antigen-binding domain formed by a VH-VL dimer. Additional examples of an antibody are described herein. Additional examples of an antibody are known in the art.

"Affinity" refers to the strength of the sum total of non-covalent interactions between an antigen-binding site and its binding partner (e.g., an antigen or epitope). Unless indicated otherwise, as used herein, "affinity" refers to intrinsic binding affinity, which reflects a 1:1 interaction between members of an antigen-binding domain and an antigen or epitope. The affinity of a molecule X for its partner Y can be represented by the dissociation equilibrium constant ($K_D$). The kinetic components that contribute to the dissociation equilibrium constant are described in more detail below. Affinity can be measured by common methods known in the art, including those described herein. Affinity can be determined, for example, using surface plasmon resonance (SPR) technology (e.g., BIACORE®) or biolayer interferometry (e.g., FORTEBIO®). Additional methods for determining the affinity for an antigen-binding domain and its corresponding antigen or epitope are known in the art.

A "single-chain polypeptide" as used herein to refers to a single protein chain. A "multi-chain polypeptide" as used herein to refers to a polypeptide comprising two or more (e.g., three, four, five, six, seven, eight, nine, or ten) protein chains (e.g., at least a first chimeric polypeptide and a second polypeptide), where the two or more proteins chains associate through non-covalent bonds to form a quaternary structure.

The term "pair of affinity domains" is two different protein domain(s) that bind specifically to each other with a $K_D$ of less than of less than $1\times10^{-7}$ M (e.g., less than $1\times10^{-8}$ M, less than $1\times10^{-9}$ M, less than $1\times10^{-10}$ M, or less than $1\times10^{-11}$ M). In some examples, a pair of affinity domains can be a pair of naturally-occurring proteins. In some embodiments, a pair of affinity domains can be a pair of synthetic proteins. Non-limiting examples of pairs of affinity domains are described herein.

The term "epitope" means a portion of an antigen that specifically binds to an antigen-binding domain. Epitopes can, e.g., consist of surface-accessible amino acid residues and/or sugar side chains and may have specific three-dimensional structural characteristics, as well as specific charge characteristics. Conformational and non-conformational epitopes are distinguished in that the binding to the former but not the latter may be lost in the presence of denaturing solvents. An epitope may comprise amino acid residues that are directly involved in the binding, and other amino acid residues, which are not directly involved in the binding. Methods for identifying an epitope to which an antigen-binding domain binds are known in the art.

The term "treatment" means to ameliorate at least one symptom of a disorder. In some examples, the disorder being treated is cancer and to ameliorate at least one symptom of cancer includes reducing aberrant proliferation, gene expression, signaling, translation, and/or secretion of factors. Generally, the methods of treatment include administering a therapeutically effective amount of a composition that reduces at least one symptom of a disorder to a subject who is in need of, or who has been determined to be in need of such treatment.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

BRIEF DESCRIPTION OF DRAWINGS

The patent or application file contains at least one drawing executed in color. Copies of this patent or patent application publication with color drawing(s) will be provided by the Office upon request and payment of the necessary fee.

FIG. 1A shows the spleen weight of mice treated with increasing dosage of the exemplary multi-chain polypeptide as compared to mice treated with the control solution. FIG. 1B shows the percentages of immune cell types present in the spleen of mice treated with increasing dosage of the exemplary multi-chain polypeptide as compared to mice treated with the control solution.

FIG. 2A shows the spleen weight over a period of 92 hours in mice treated with 3 mg/kg of the exemplary multi-chain polypeptide. FIG. 2B shows the percentages of immune cell types present in the spleen over a period of 92 hours in mice treated with 3 mg/kg of the exemplary multi-chain polypeptide.

FIG. 3A shows the expression of Ki67 in CD4$^+$ T cells, CD8$^+$ T cells, natural killer (NK) cells, and CD19$^+$ B cells at various time points post-treatment with the multi-chain polypeptide. FIG. 3B shows the expression of Granzyme B in CD4$^+$ T cells, CD8$^+$ T cells, natural killer (NK) cells, and CD19$^+$ B cells at various time points post-treatment with the multi-chain polypeptide.

FIG. 5A shows the percentages of the different cell types in each control and experimental group. FIG. 5B shows the proliferation rate of the of the different cell types in each control and experimental group.

FIG. 9A shows chemotherapy induction of senescent B16F10 cells visualized using SA β-gal staining. FIGS. 9B-9F show expression of p21$^{CIP1}$, IL6, DPP4, RATE1E, and ULBP1 over time in the chemotherapy-induced senescent B16F10 cells.

FIG. 10A shows colony formation by chemotherapy-induced senescent B16F10 cells. FIGS. 10B and 10C show expression of Oct4 mRNA and Notch4 mRNA by chemotherapy-induced senescent B16F10 cells as compared to control B16F10 cells. FIGS. 10D-10F show percentage of chemotherapy-induced senescent B16F10 cells double-positive for two out of the three stem cell markers including CD44, CD24, and CD133.

FIG. 11A shows the results of a migration assay comparing chemotherapy-induced senescent cells with stem cell properties (B16F10-SNC-CSC) with control B16F10 cells. FIGS. 11B and 11C show the results of an invasion assay comparing chemotherapy-induced senescent cells with stem cell properties (B16F10-SNC-CSC) with control B16F10 cells.

FIG. 12A shows an exemplary schematic of a process of obtaining in vitro expanded NK cells. FIG. 12 B shows cytotoxicity of the expanded NK cells against chemotherapy-induced senescent cells with stem cell properties (B16F10-SNC-CSC) or control B16F10 cells.

FIG. 13A shows an exemplary schematic for treating melanoma in a mouse model. FIGS. 13B and 13C show the change in tumor volume over time with combination treatments including TGFRt15-TGFRs as compared to chemotherapy or TA99 treatment alone.

FIG. 84A shows binding affinity of TGFRT15-16S21 with CHO cells expressing human CD16b. FIG. 84B shows binding affinity of 7t15-21s with CHO cells expressing human CD16b.

FIG. 94A shows spleen weight in mice treated with 7t15-7s as compared to PBS control. FIG. 94B shows the percentage of CD4$^+$ T cells, CD8$^+$ T cells, and NK cells in mice treated with 7t15-7s as compared to PBS control.

FIG. 103A shows spleen weight in mice treated with TGFRt15-TGFRs as compared to PBS control. FIG. 103B shows the percentage of CD4+ T cells, CD8+ T cells, and NK cells in mice treated with TGFRt15-TGFRs as compared to PBS control.

FIG. 104A shows spleen weight of mice treated with TGFRt15-TGFRs at 16, 24, 48, 72, and 92 hours after treatment. FIG. 104B shows the percentages of immune cells in mice treated with TGFRt15-TGFRs at 16, 24, 48, 72, and 92 hours after treatment.

FIG. 114A shows detection of IL-15 in 7t15-21s137L (short version) with ELISA. FIG. 114B shows detection of IL21 in 7t15-21s137L (short version) with ELISA. FIG. 114C shows detection of IL7 in 7t15-21s137L (short version) with ELISA.

FIG. 121 shows results of a 32E43 cell proliferation assay with 7t15-TGFRs or recombinant IL-15.

FIG. 122 is a line graph showing the chromatographic profile of 7t15-TGFRs protein containing cell culture supernatant following binding and elution on anti-TF antibody resin.

FIG. 123 shows 7t15-TGFRs before and after deglycosylation as analyzed using reduced SDS-PAGE.

FIG. 124 shows ELISA detection of IL-7, IL-15 and TGFβRII in the 7t15-TGFRs protein.

Figure 125A:
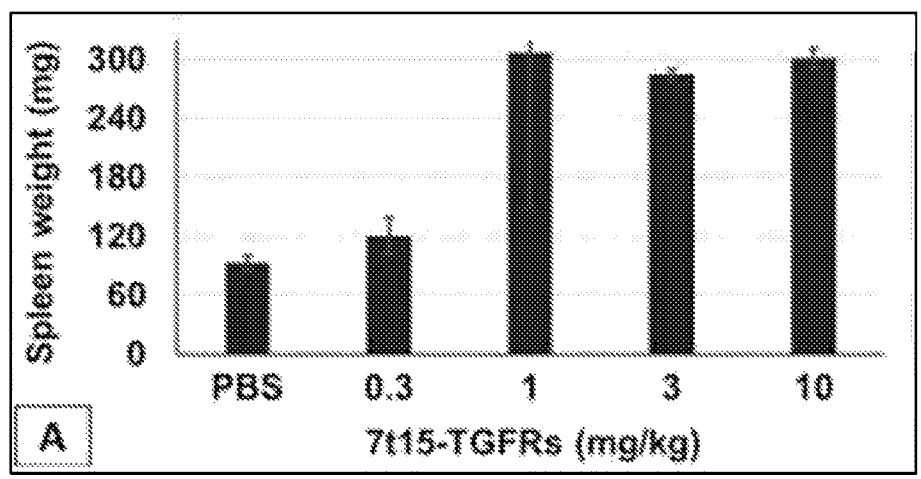
Figure 125B:
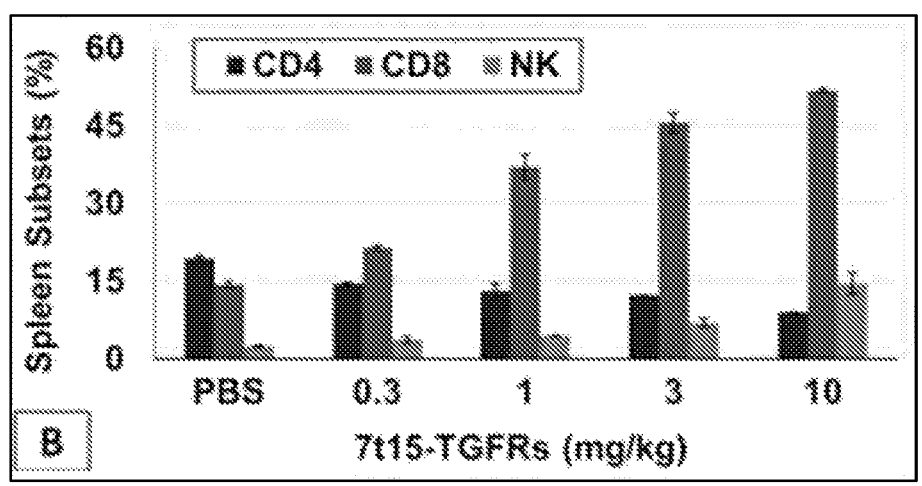

FIGS. 125A and 125B show spleen weight and the percentages of immune cell types in 7t15-TGFRs-treated and control-treated mice. FIG. 125A shows spleen weight in mice treated with 7t15-TGFRs at various dosages, as compared to PBS control. FIG. 125B shows the percentage of CD4+ T cells, CD8+ T cells, and NK cells in mice treated with 7t15-TGFRs at various dosages, as compared to PBS control.

Figure 126A:
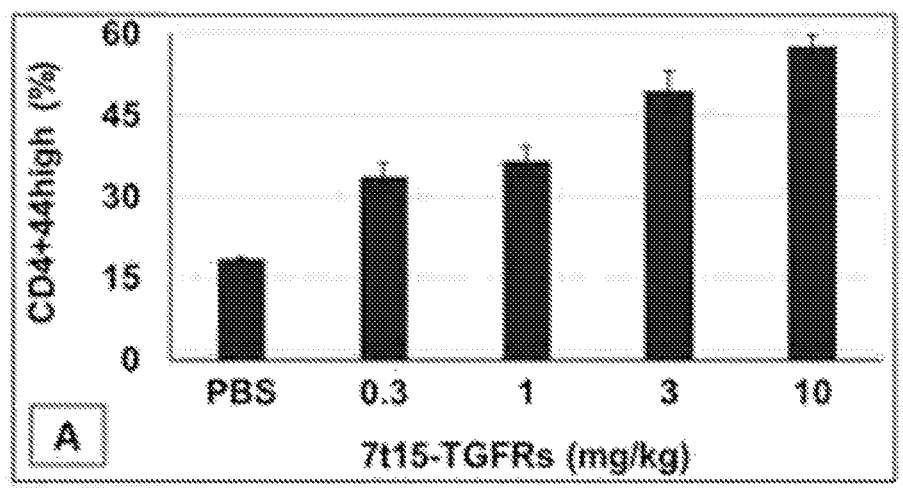
Figure 126B:
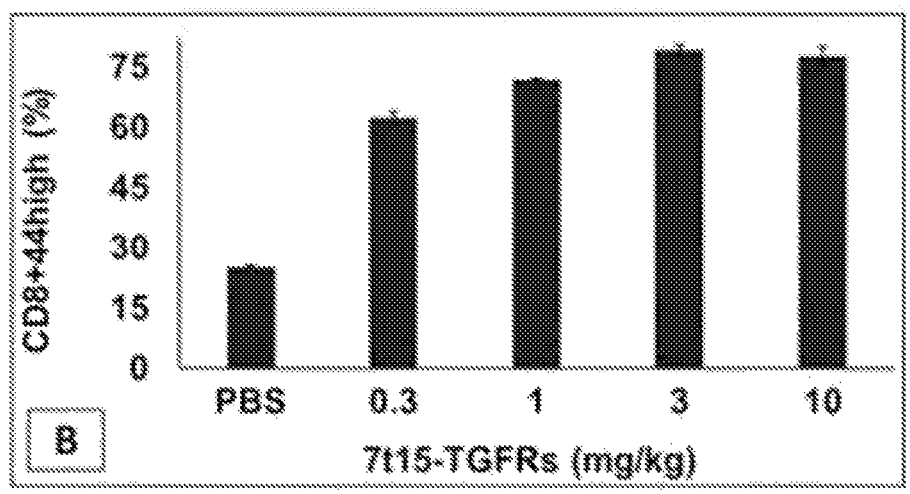

FIGS. 126A and 126B show upregulation of CD44 expression of CD4+ and CD8+ T cells by 7t15-TGFRs in C57BL/6 mice.

Figure 127A:
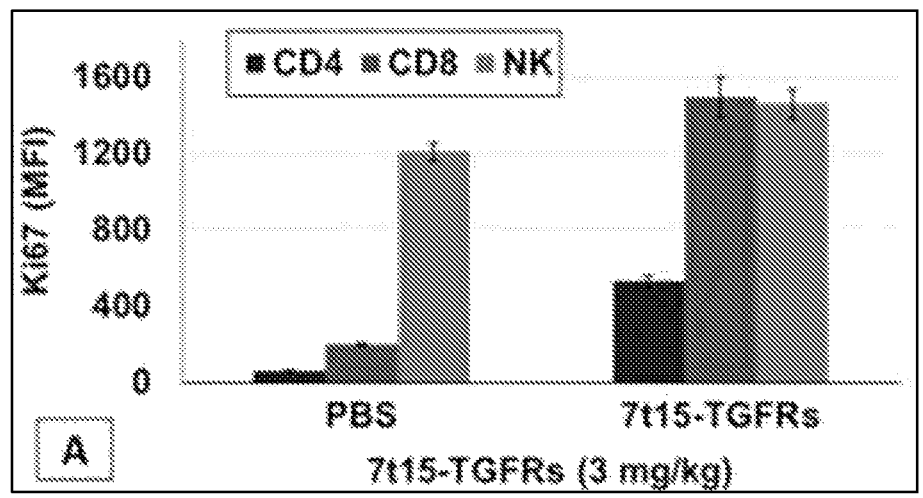
Figure 127B:
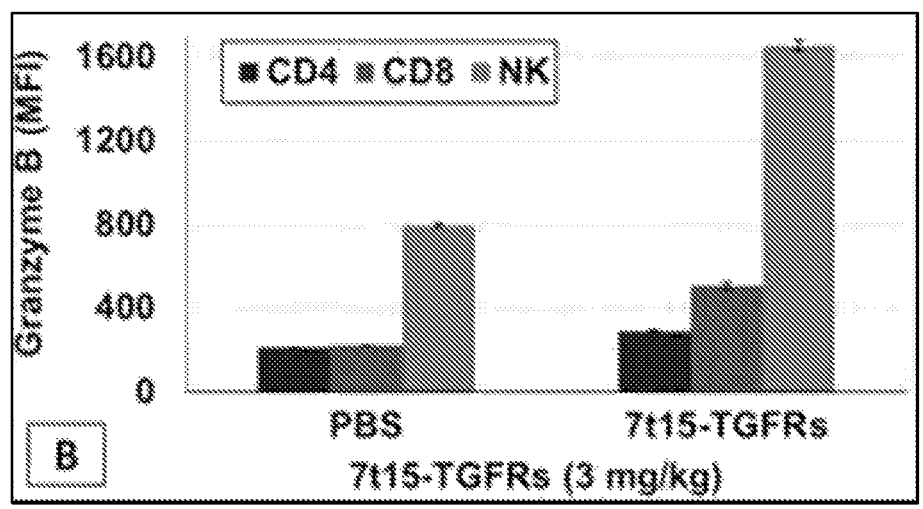

FIGS. 127A and 127B show upregulation of Ki67 expression and Granzyme B expression of CD8+ T cells and NK Cells by 7t15-TGFRs in C57BL/6 mice.

Figure 128:
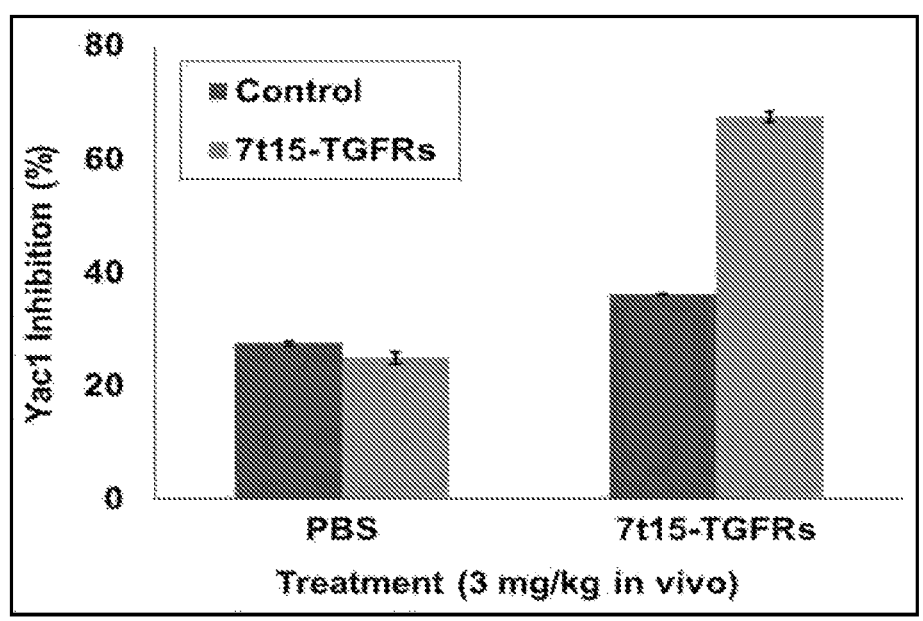

FIG. 128 shows enhancement of cytotoxicity of splenocytes by 7t15-TGFRs in C57BL/6 mice.

Figure 129:
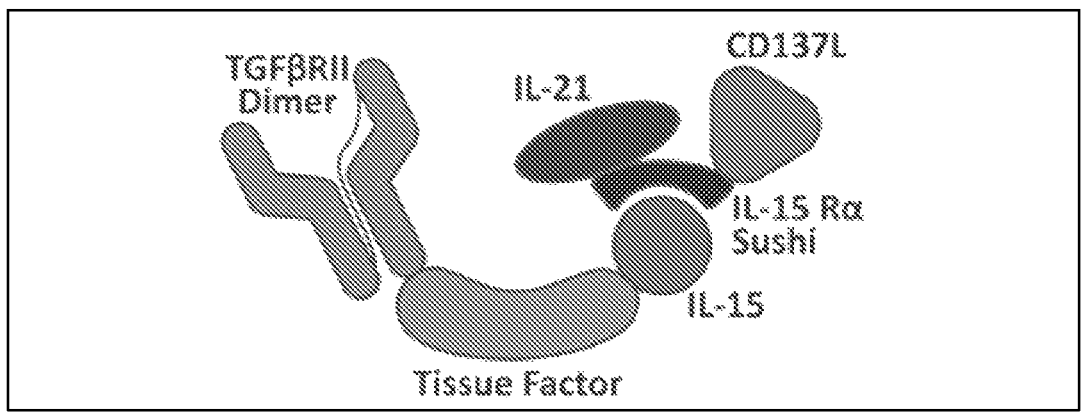

FIG. 129 shows a schematic of the TGFRt15-21s137L construct.

Figure 130:
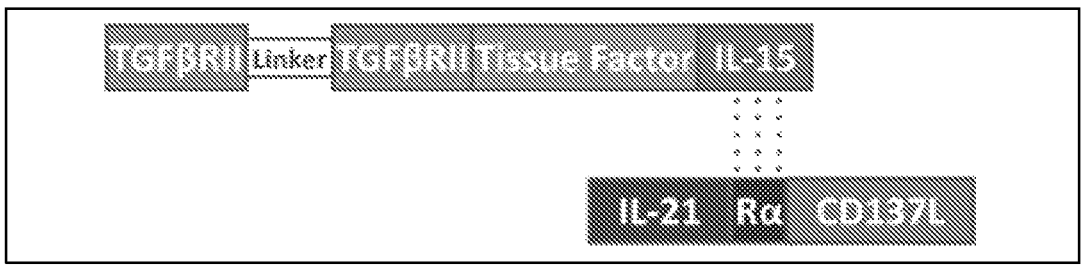

FIG. 130 shows an additional schematic of the TGFRt15-21s137L construct.

Figure 131:
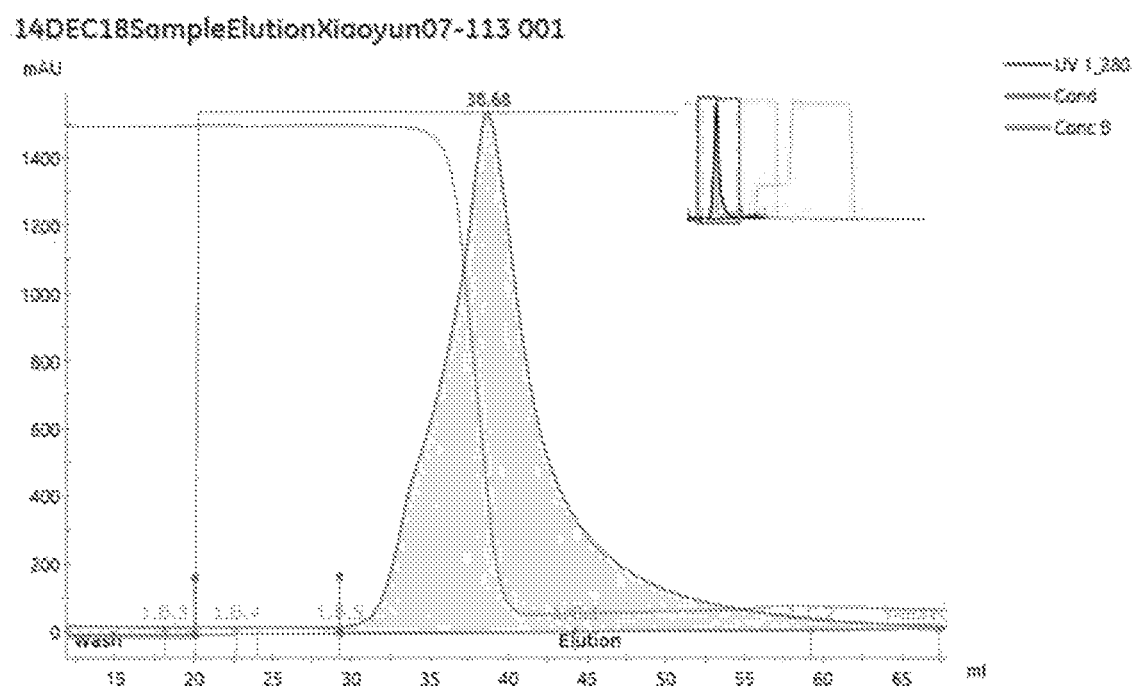

FIG. 131 is a line graph showing the chromatographic profile of TGFRt15-21s137L protein containing cell culture supernatant following binding and elution on anti-TF antibody resin.

Figure 132:
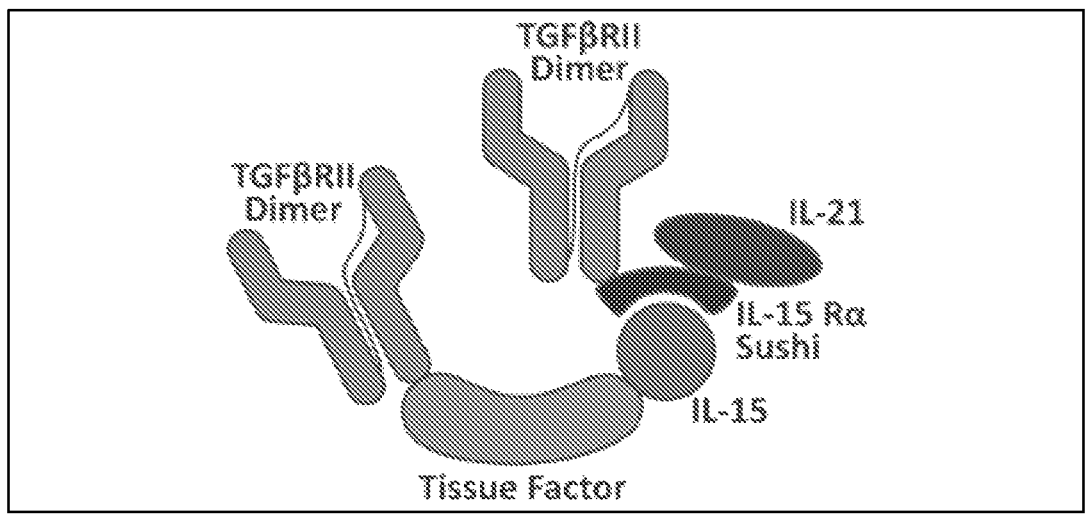

FIG. 132 shows a schematic of the TGFRt15-TGFRs21 construct.

Figure 133:
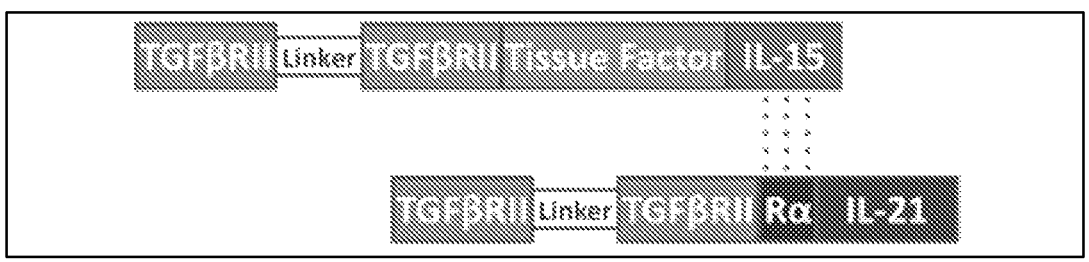

FIG. 133 shows an additional schematic of the TGFRt15-TGFRs21 construct.

Figure 134:
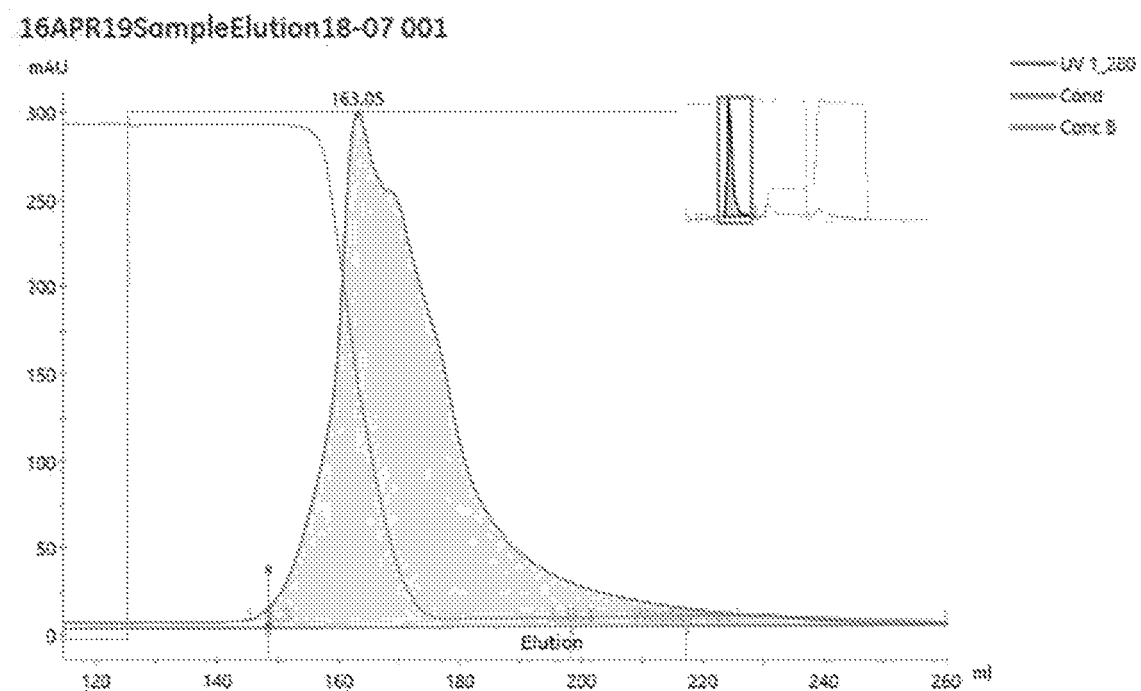

FIG. 134 is a line graph showing the chromatographic profile of TGFRt15-TGFRs21 protein containing cell culture supernatant following binding and elution on anti-TF antibody resin.

Figure 135:
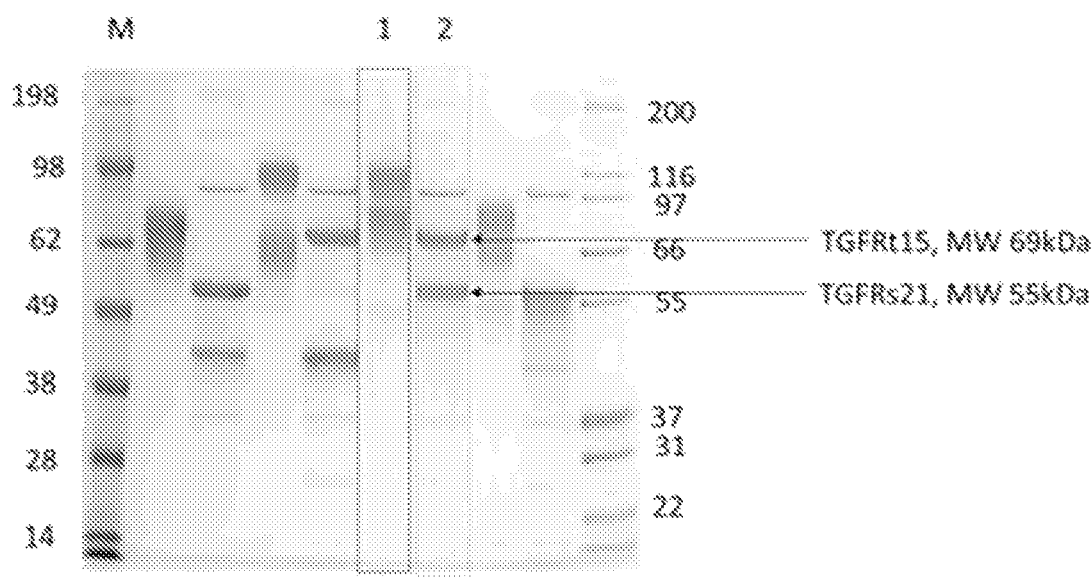

FIG. 135 shows TGFRt15-TGFRs21 before and after deglycosylation as analyzed by reduced SDS-PAGE.

Figure 136A:
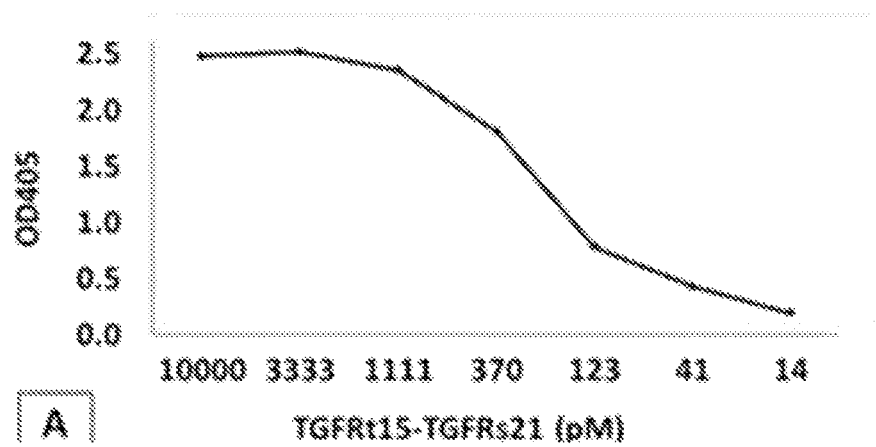
Figure 136B:
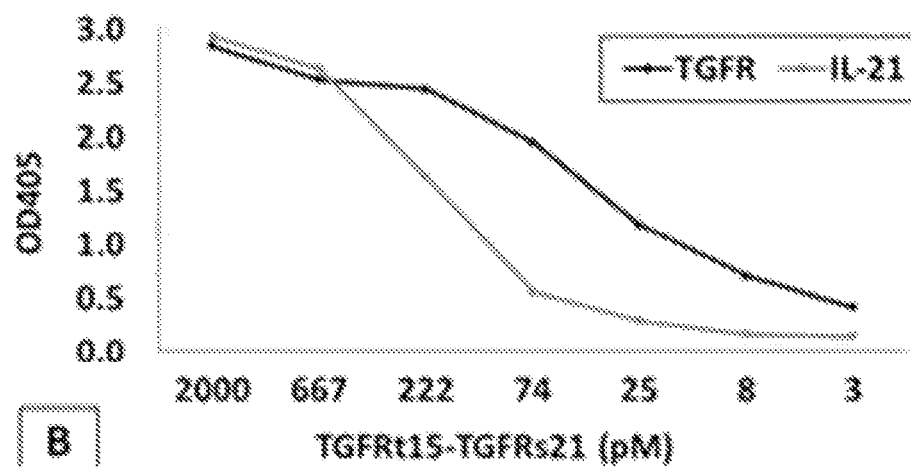

FIGS. 136A and 136B show detection of components of TGFRt15-TGFRs21 using ELISA.

Figure 137A:
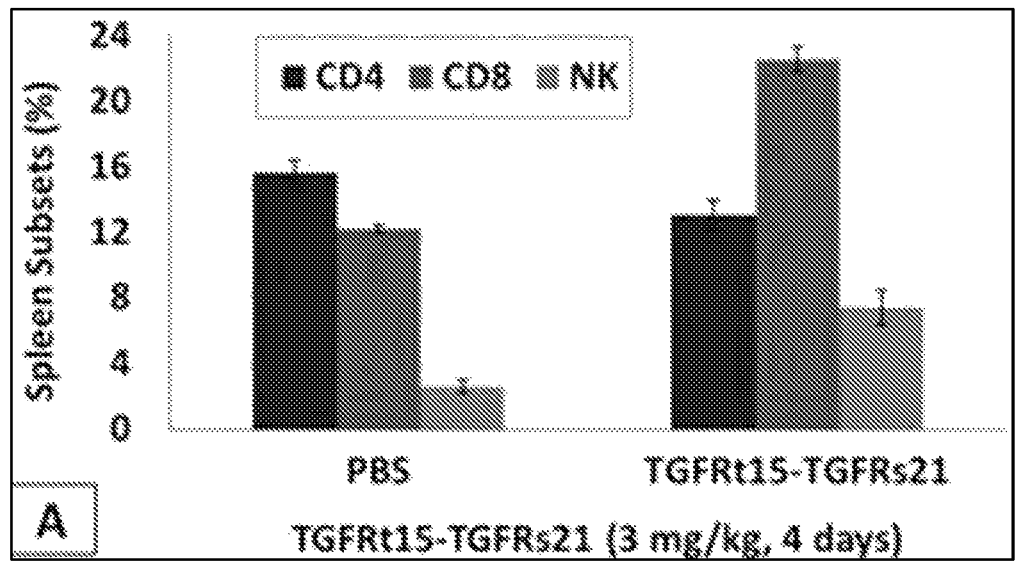
Figure 137B:
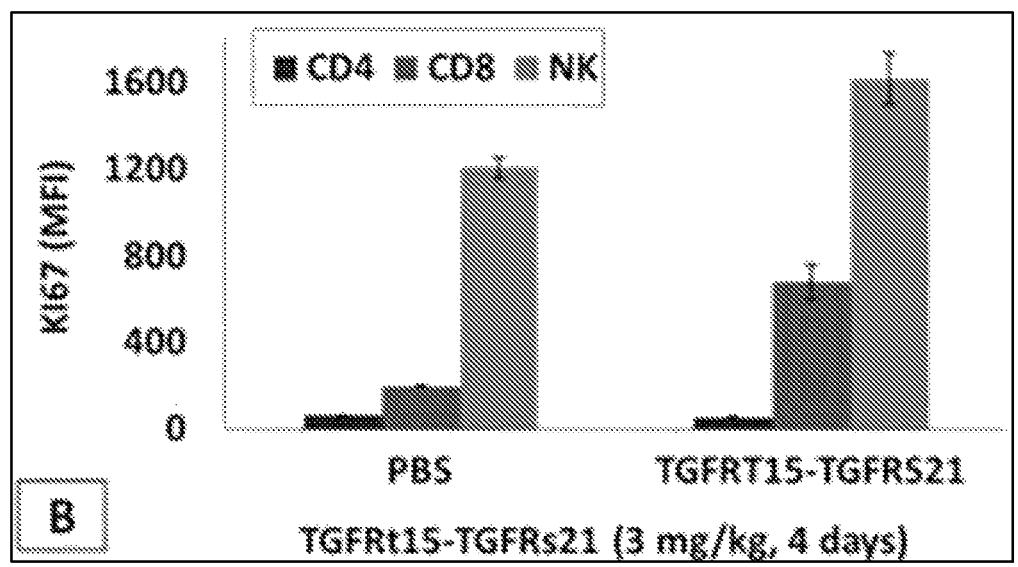

FIGS. 137A and 137B show the percentages and proliferation of CD4+ T cells, CD8+ T cells, and natural killer (NK) cells present in the spleen of control-treated and TGFRt15-TGFRs21-treated mice.

Figure 138:
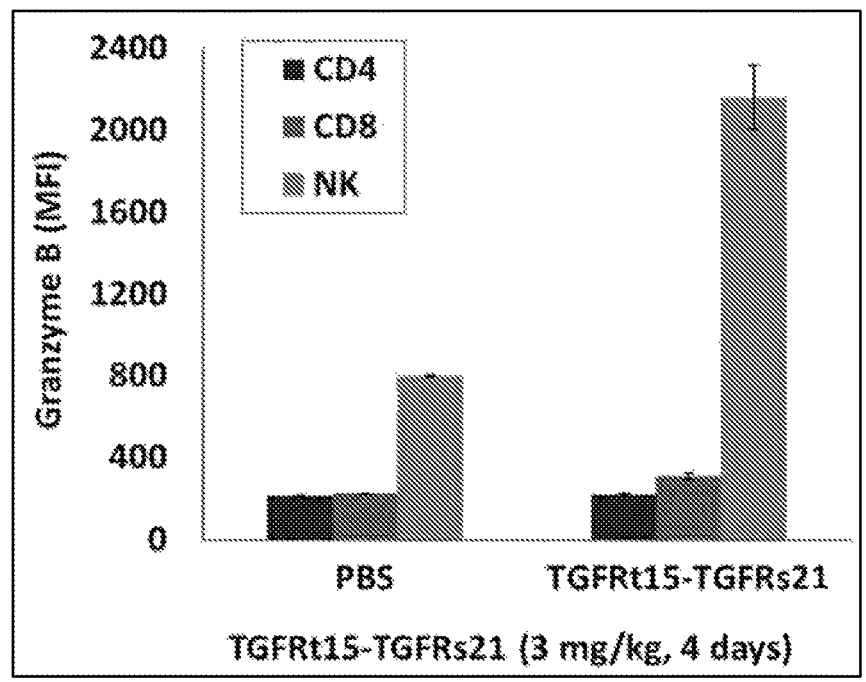

FIG. 138 shows upregulation of Granzyme B expression of splenocytes in mice treated with TGFRt15-TGFRs21.

Figure 139:
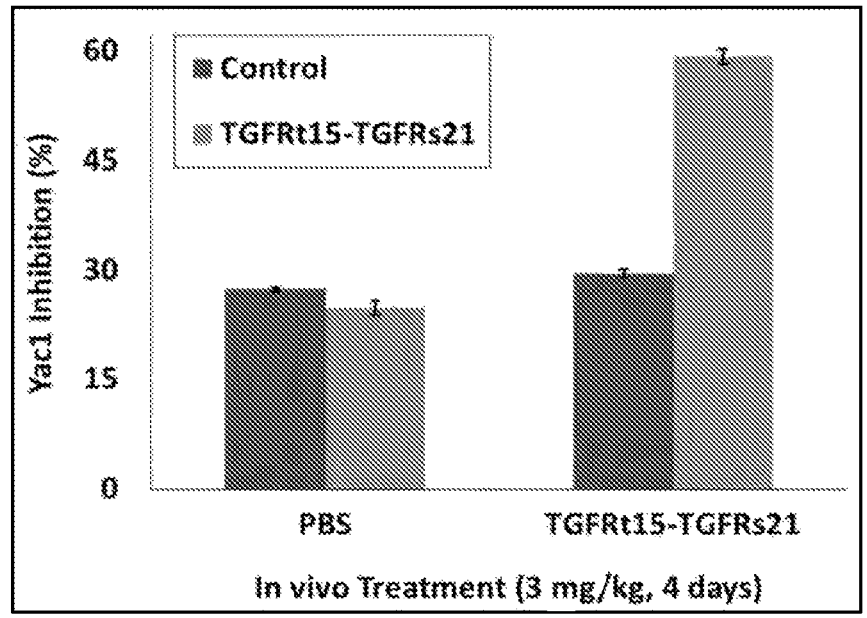

FIG. 139 shows enhancement of cytotoxicity of splenocytes by TGFRt15-TGFRs21 in C57BL/6 Mice.

Figure 140:
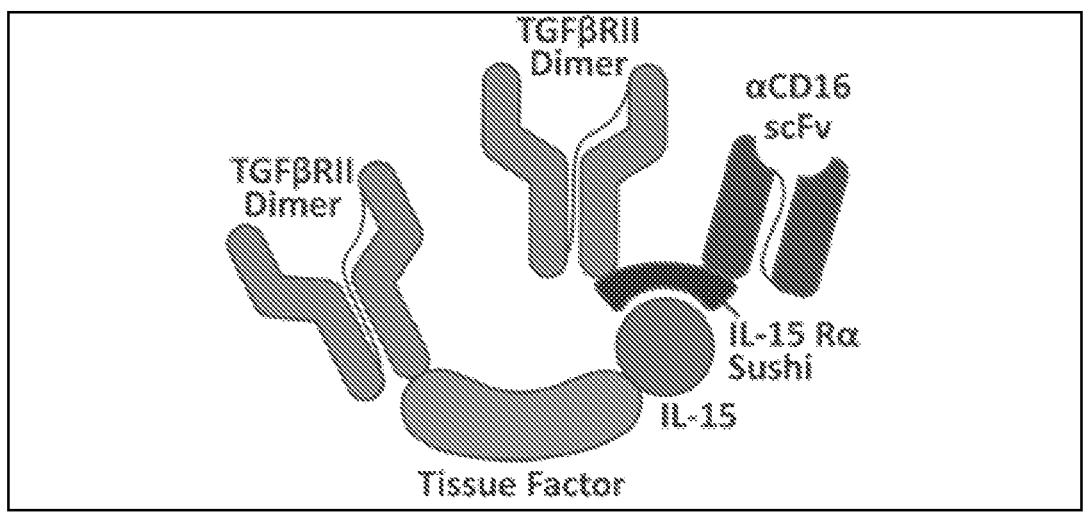

FIG. 140 shows a schematic of the TGFRt15-TGFRs16 construct.

Figure 141:
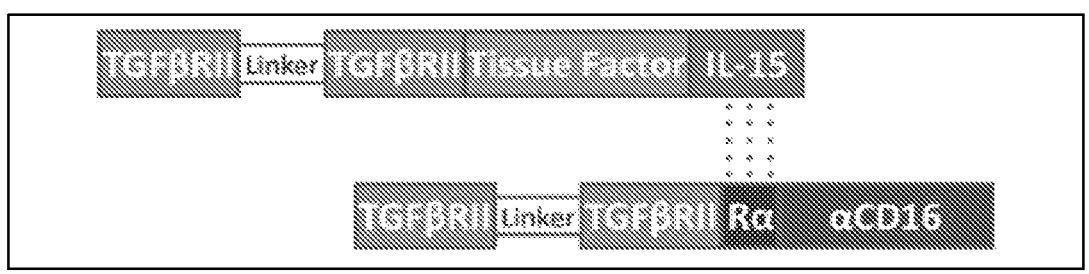

FIG. 141 shows an additional schematic of the TGFRt15-TGFRs16 construct.

Figure 142:
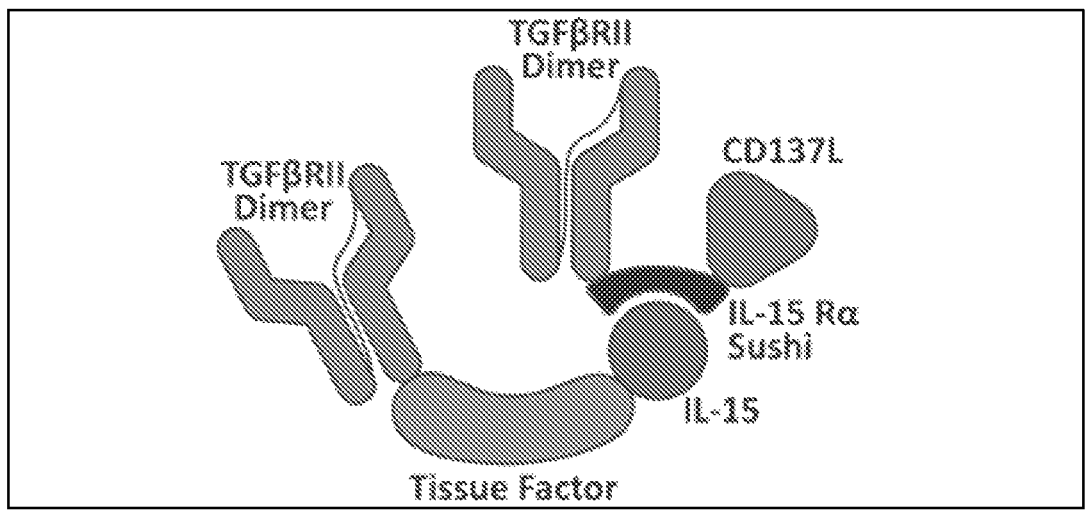

FIG. 142 shows a schematic of the TGFRt15-TGFRs137L construct.

Figure 143:
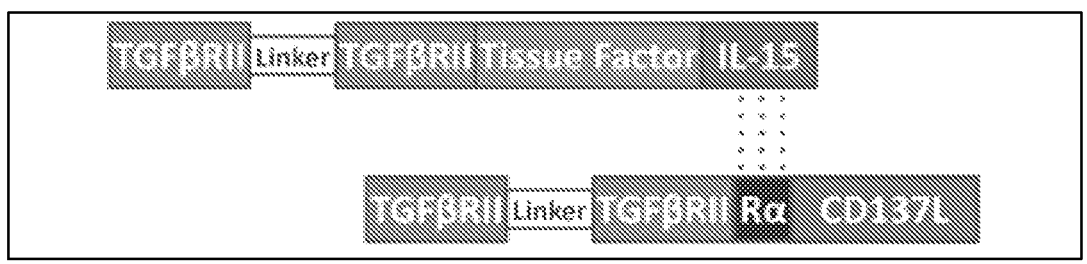

FIG. 143 shows an additional schematic of the TGFRt15-TGFRs137L construct.

Figure 144:
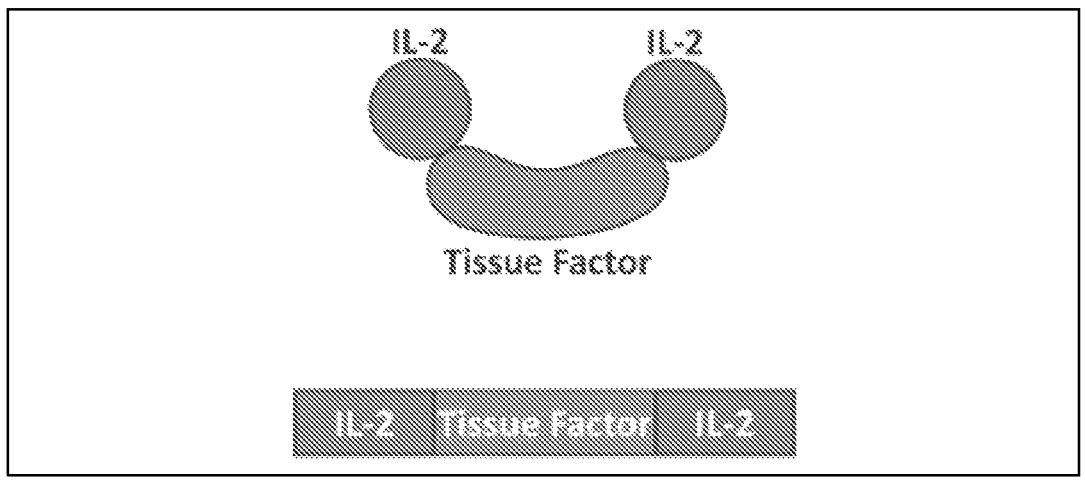

FIG. 144 are schematic diagrams of an exemplary 2t2 single-chain chimeric polypeptide.

Figure 145:
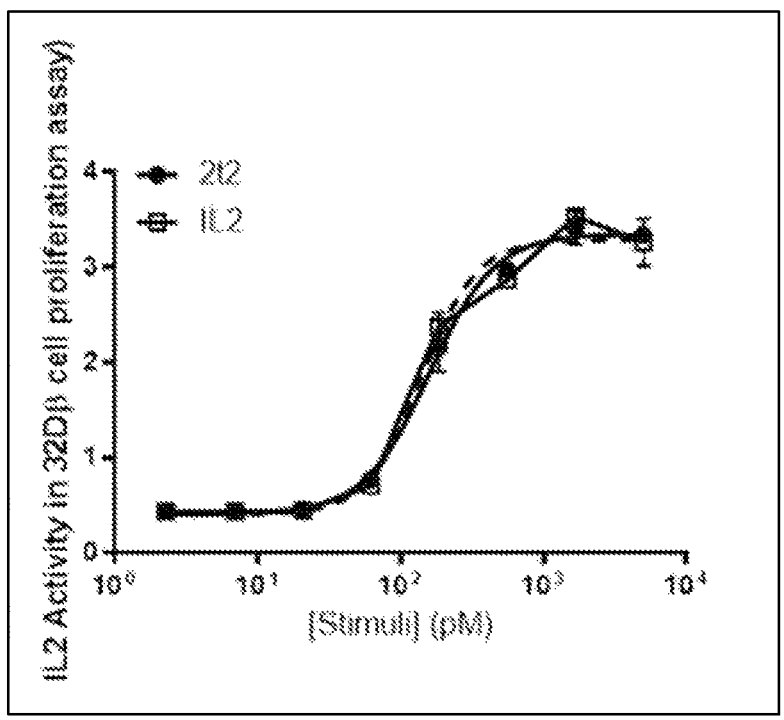

FIG. 145 shows IL-2 activity in 2t2 as compared to recombinant IL-2 using a 32DP cell proliferation assay.

Figure 146:
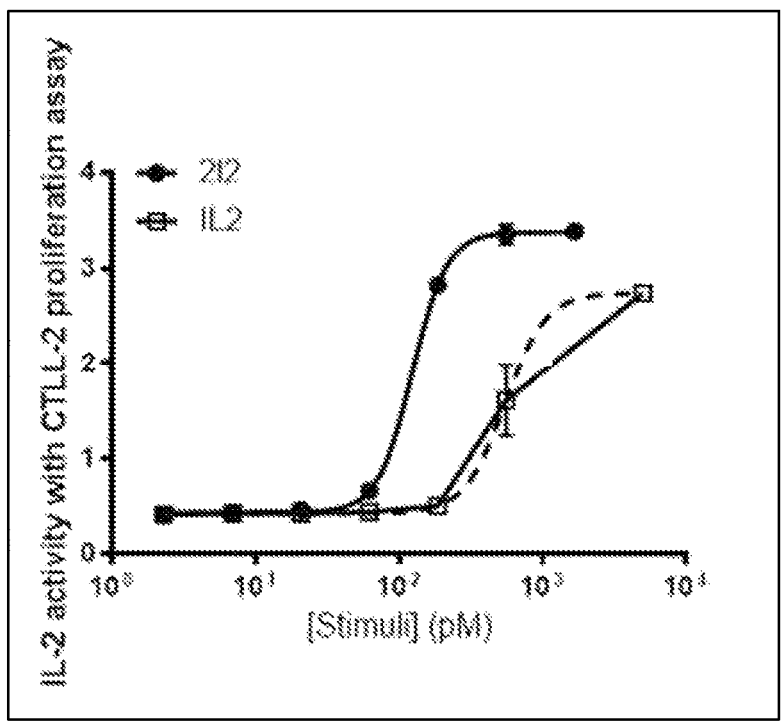

FIG. 146 shows IL-2 activity in 2t2 as compared to recombinant IL-2 using a CTLL-2 cell proliferation assay.

Figure 147:
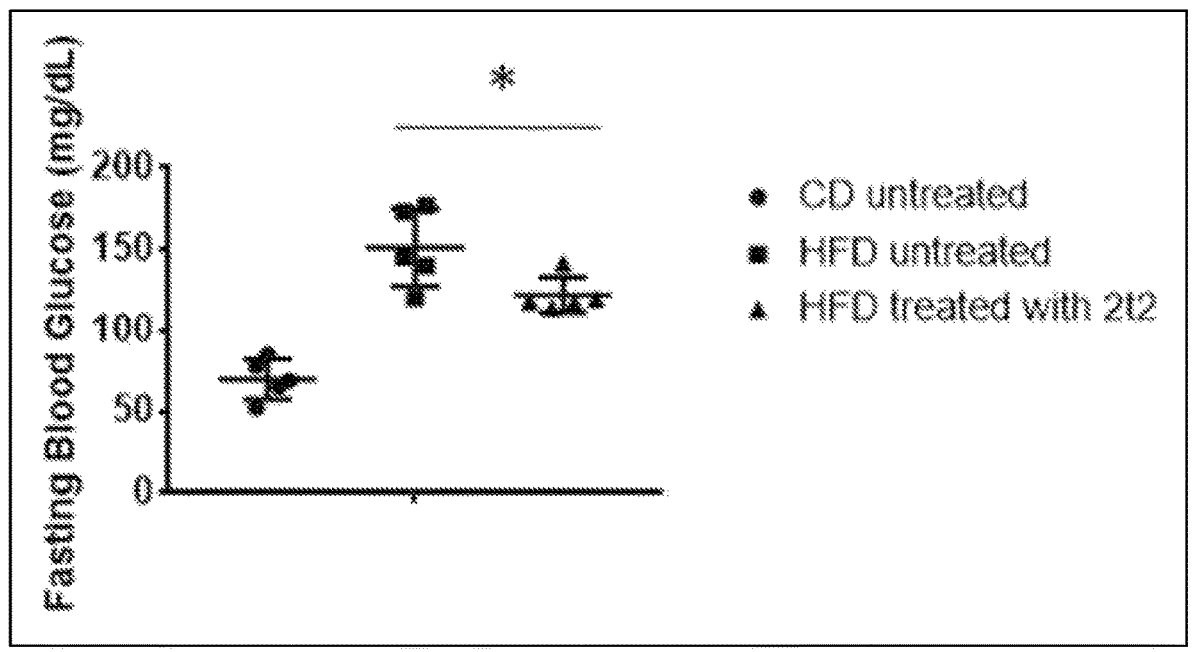

FIG. 147 shows the fasting blood glucose levels in ApoE$^{-/-}$ mice fed with standard chow or a high fat diet and treated with a PBS control (untreated) or with 2t2.

Figure 148:
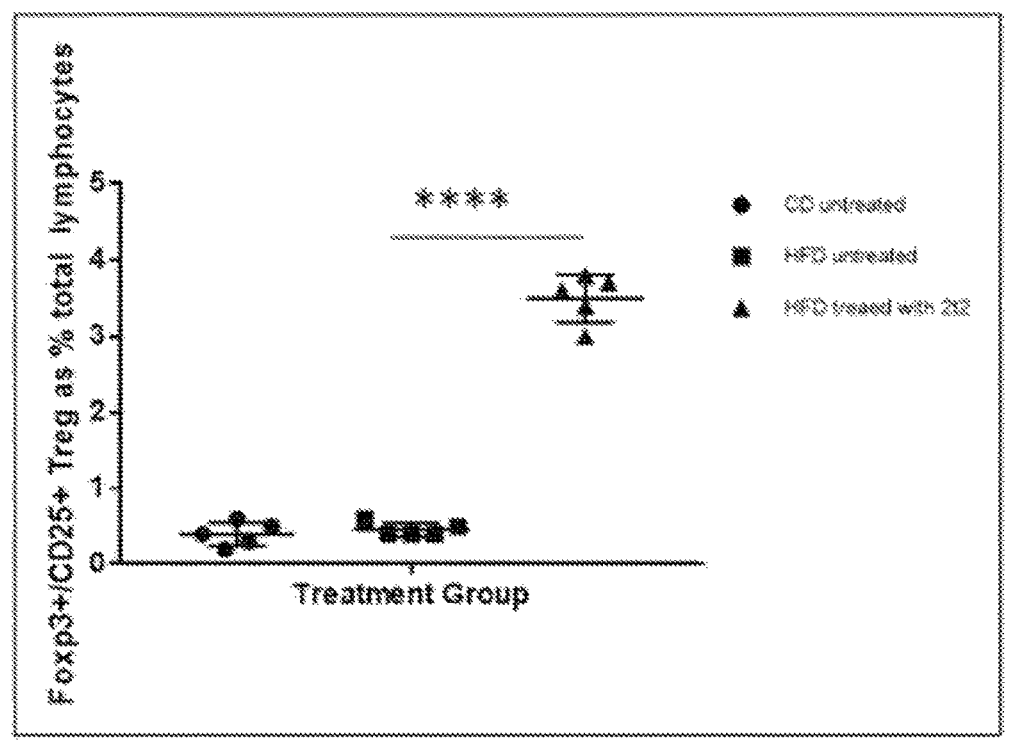

FIG. 148 shows the ratio of CD4$^+$CD25$^+$FoxP3$^+$ T regulatory cells in blood lymphocytes from ApoE$^{-/-}$ mice fed with standard chow or a high fat diet and treated with a PBS control (untreated) or with 2t2.

Figure 149:
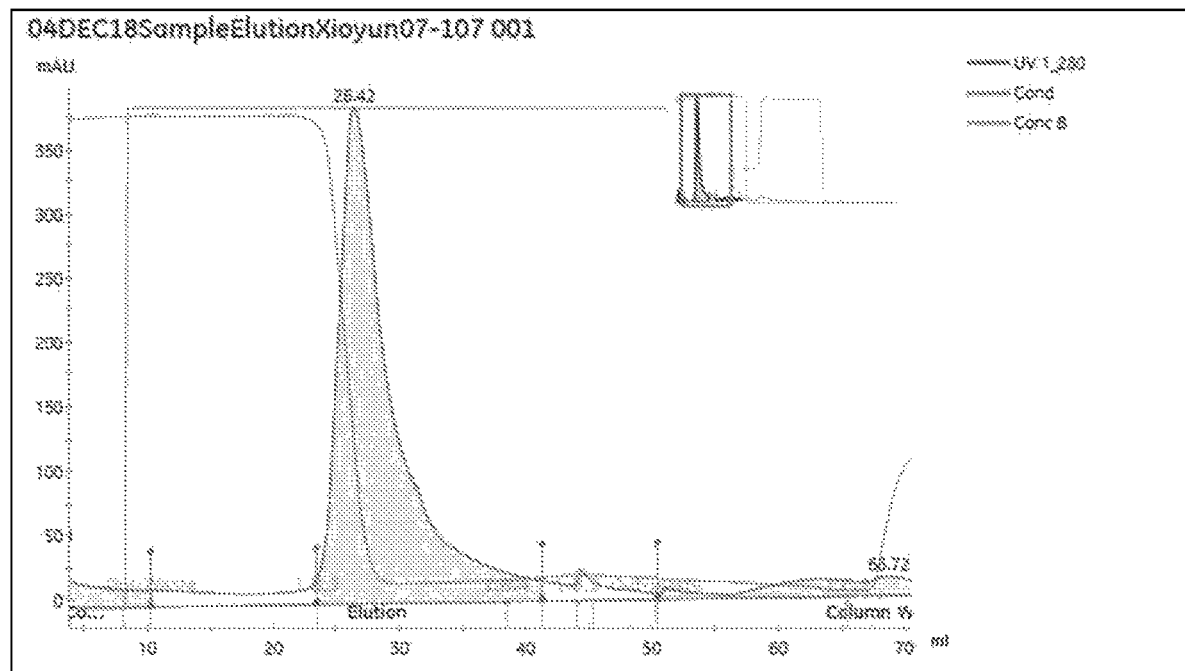

FIG. 149 is a line graph showing the chromatographic profile of 2t2 protein containing cell culture supernatant following binding and elution on anti-TF antibody resin.

Figure 150:
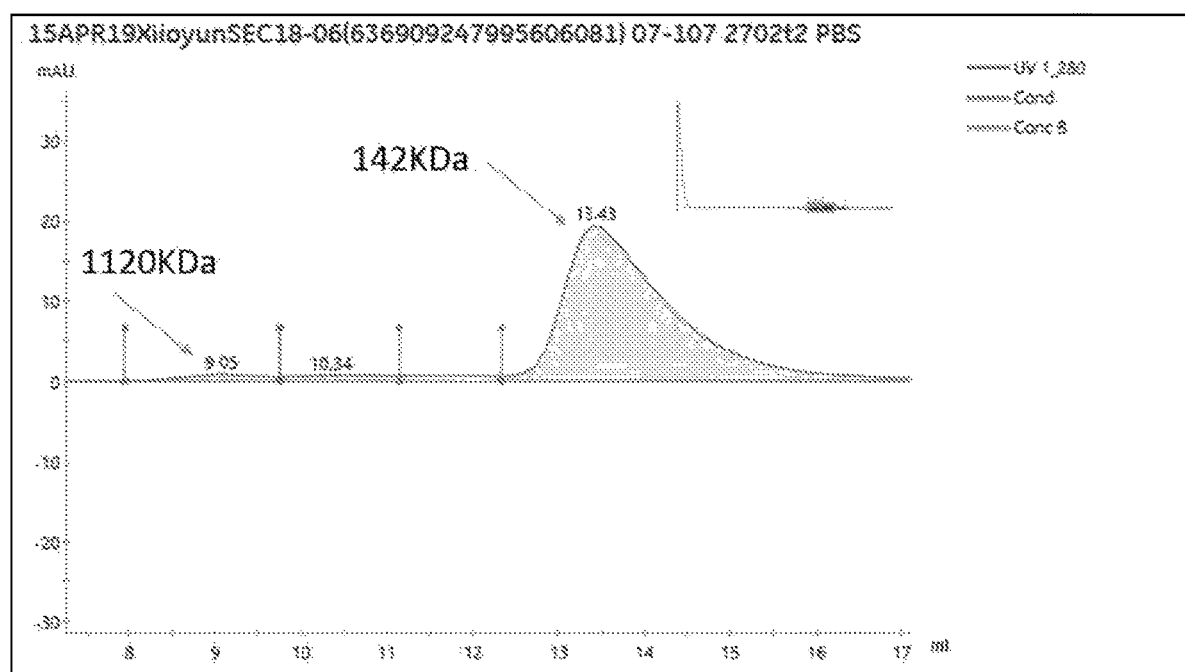

FIG. 150 shows an analytical SEC profile of 2t2.

Figure 151A:
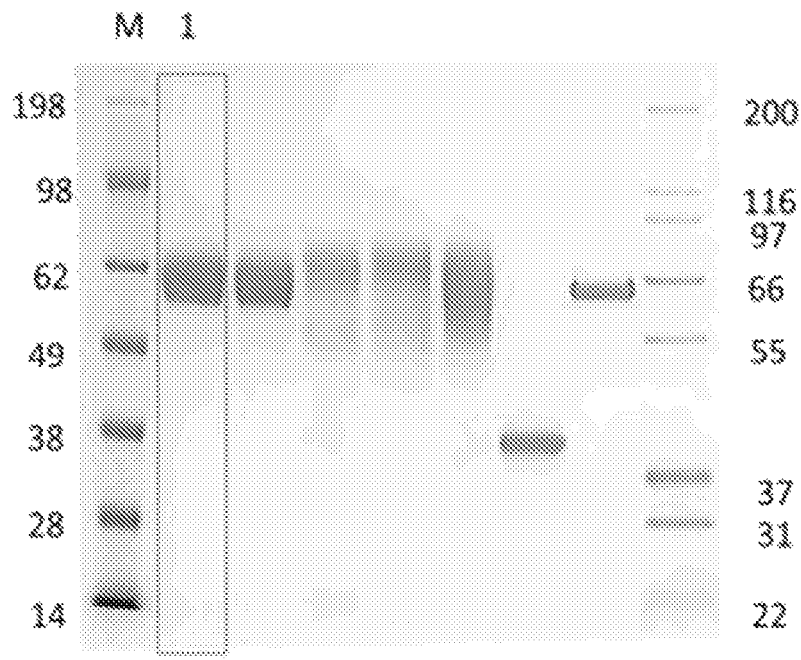
Figure 151B:
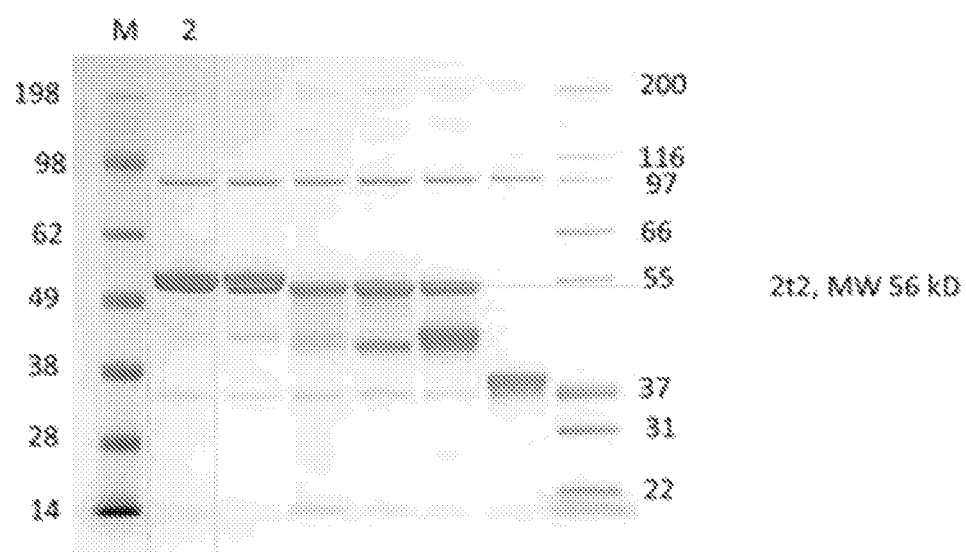

FIGS. 151A and 151B show reduced SDS-PAGE analysis of 2t2 before and after deglycosylation. FIG. 151A shows reduced SDS-PAGE analysis of 2t2 before deglycosylation. FIG. 151B shows reduced SDS-PAGE analysis of 2t2 after deglycosylation.

Figure 152A:
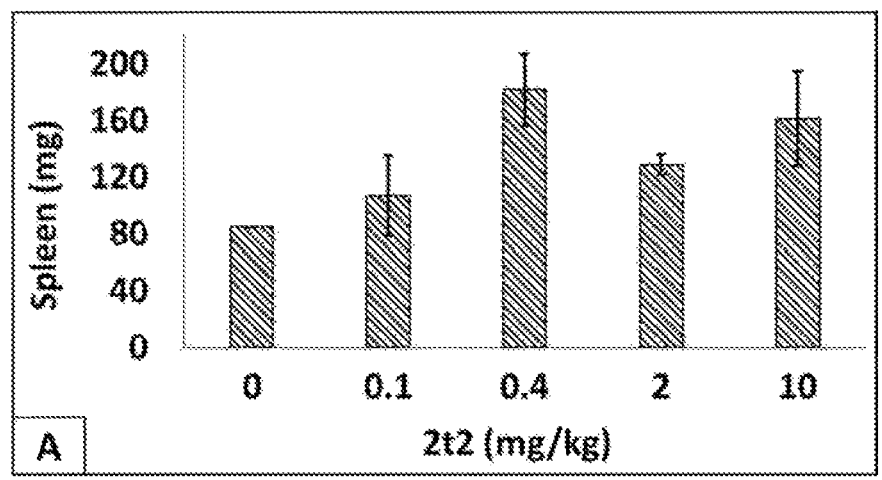
Figure 152B:
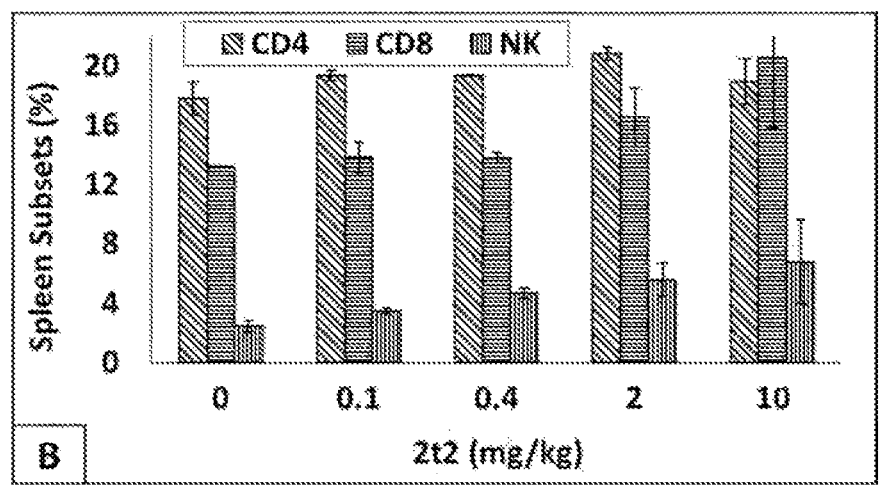

FIGS. 152A and 152B show results of immunostimulation in C57BL/6 mice using 2t2. FIG. 152A shows spleen weight following treatment with 2t2. FIG. 152B shows the percentages of immune cell types following 2t2 treatment.

Figure 153:
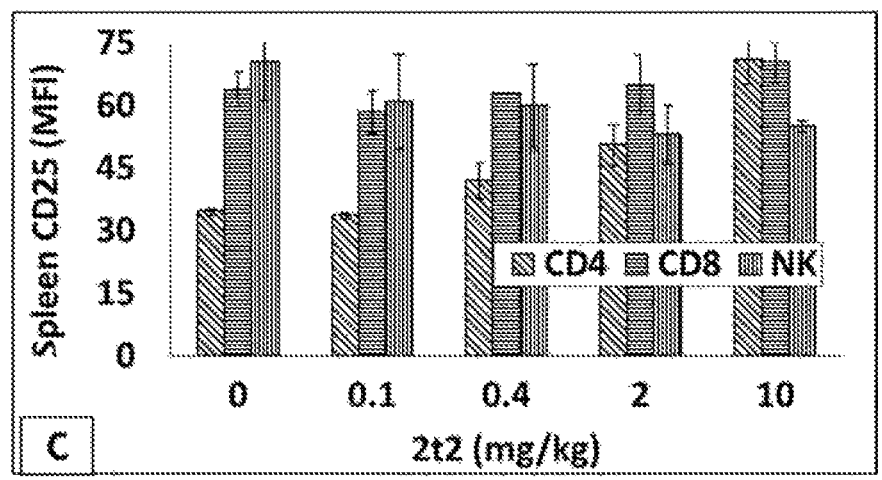

FIG. 153 shows upregulation of CD25 expression of CD4$^+$ T cells in mice treated with 2t2.

Figure 154:
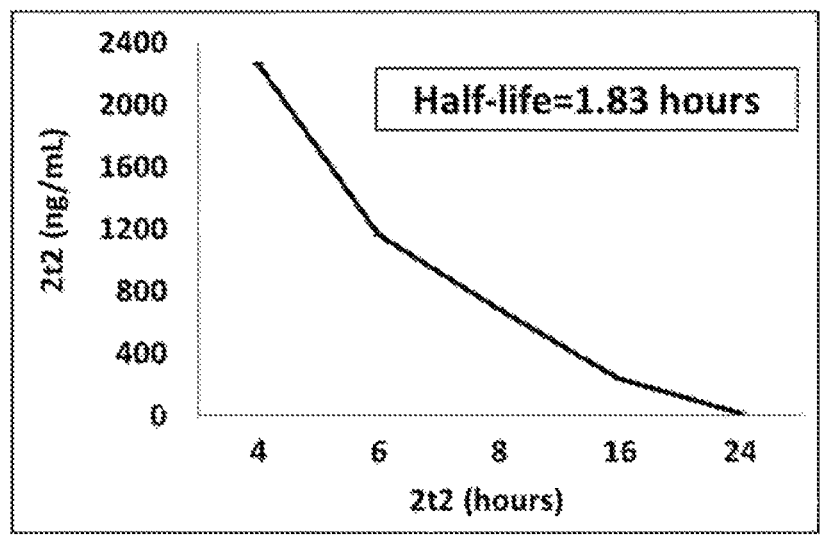

FIG. 154 shows the pharmacokinetics of 2t2 in C57BL/6 mice.

Figure 155A:
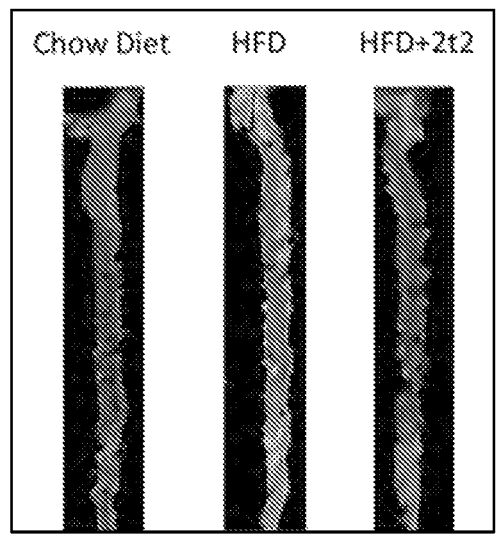
Figure 155B:
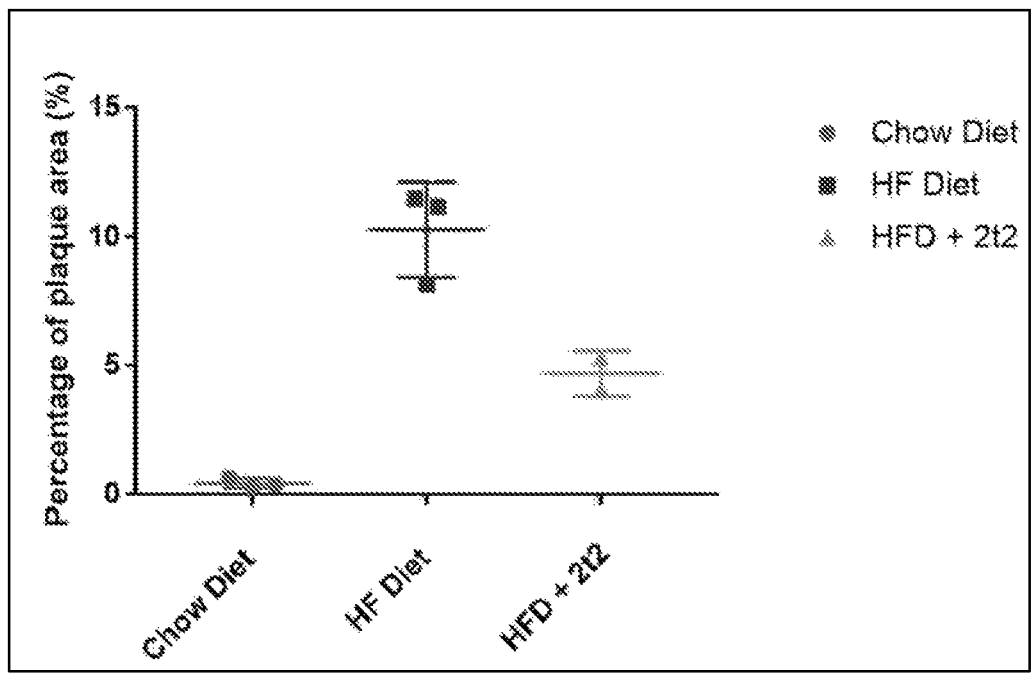

FIGS. 155A and 155B show effects of 2t2 in attenuating the formation of high fat-induced atherosclerotic plaques in ApoE$^{-/-}$ mice. FIG. 155A shows a representative view of atherosclerotic plaques from ApoE$^{-/-}$ mice fed with standard chow or a high fat diet and treated with either PBS control or 2t2. FIG. 155B shows the results of quantitative analysis of atherosclerotic plaques of each group.

Figure 156:
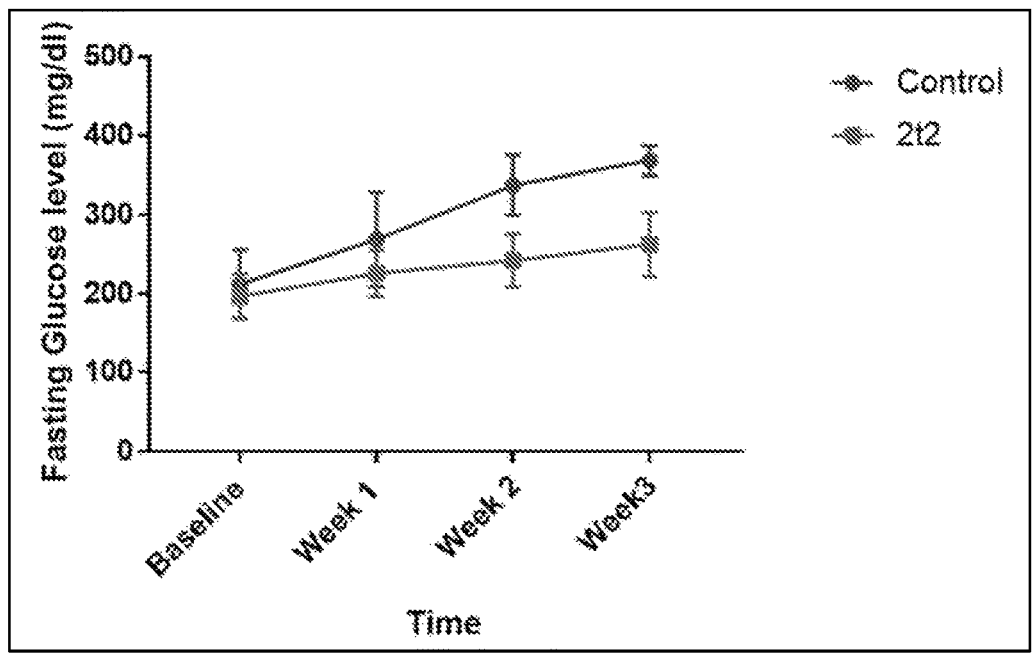

FIG. 156 shows fasting glucose levels in 2t2 treated-mice as compared to control-treated mice.

Figure 157:
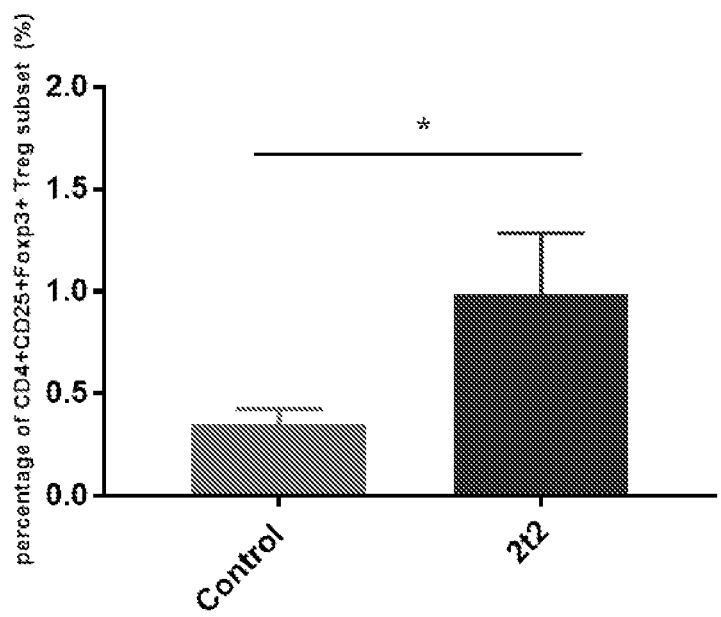

FIG. 157 shows the percentage of CD4$^+$CD25$^+$FoxP3$^+$ Tregs in blood lymphocytes from mice treated with 2t2 and control-treated mice.

Figure 158:
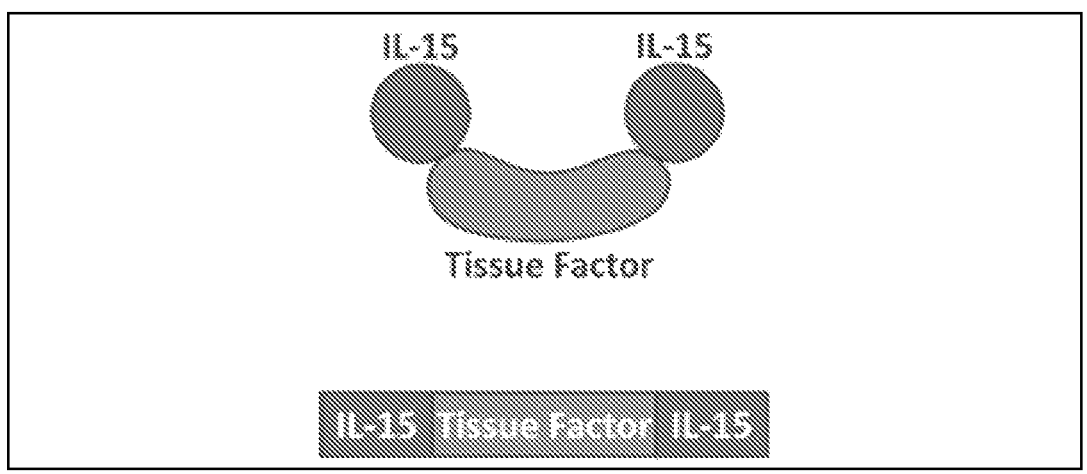

FIG. 158 are schematic diagrams of an exemplary 15t15 single-chain chimeric polypeptide.

Figure 159:
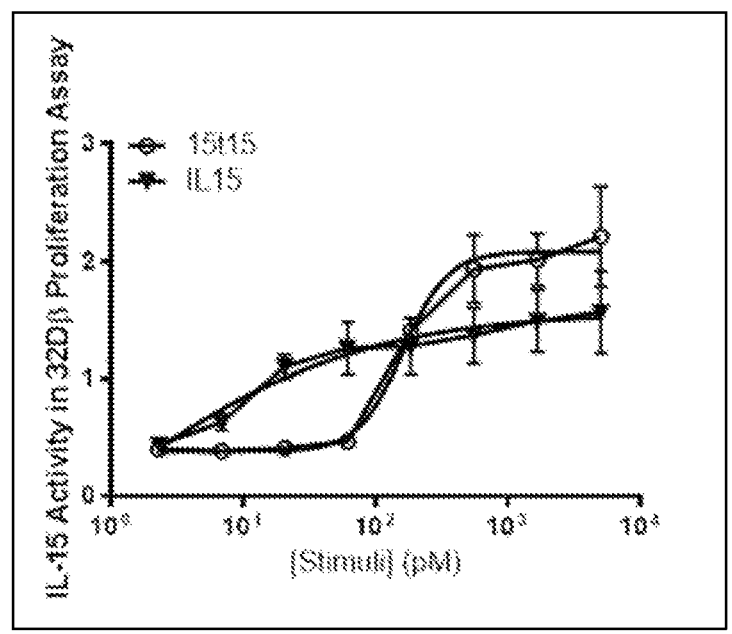

FIG. 159 shows the IL-15 activity of 15t15 as compared to recombinant IL-15 in a 32Dβ cell proliferation assay.

Figure 160:
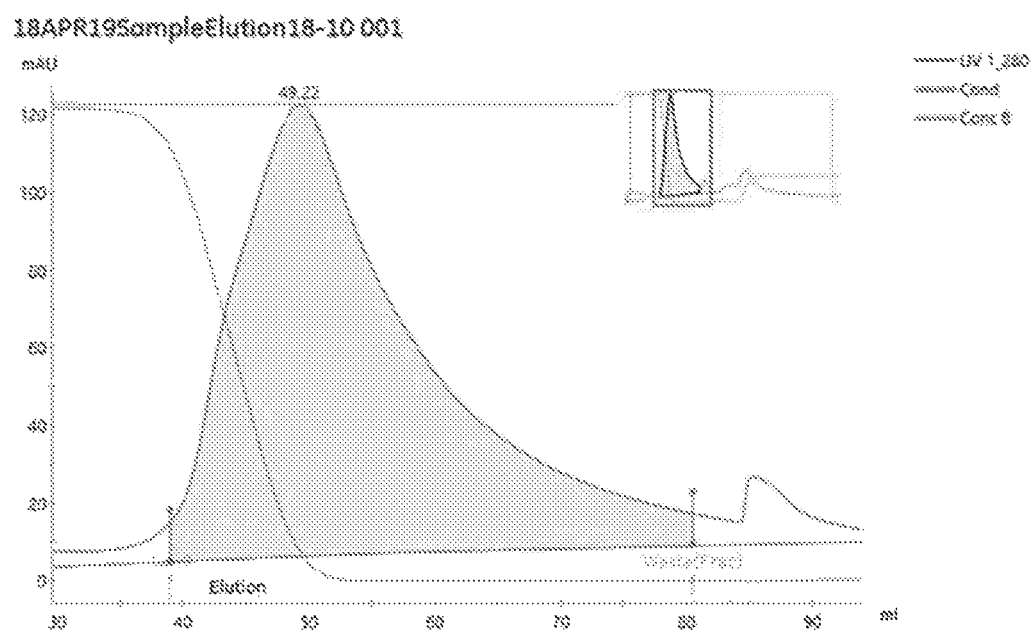

FIG. 160 is a line graph showing the chromatographic profile of 15t15 protein containing cell culture supernatant following binding and elution on anti-TF antibody resin.

Figure 161A:
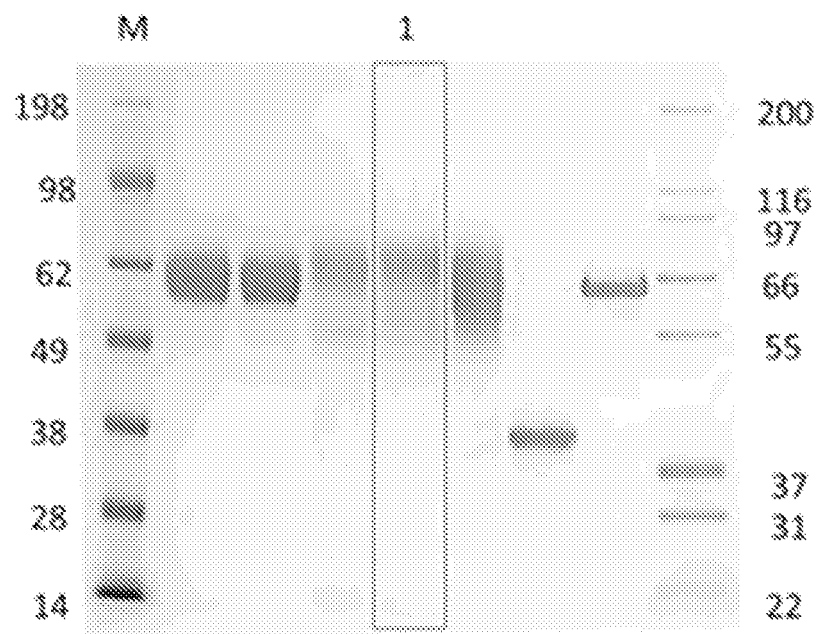
Figure 161B:
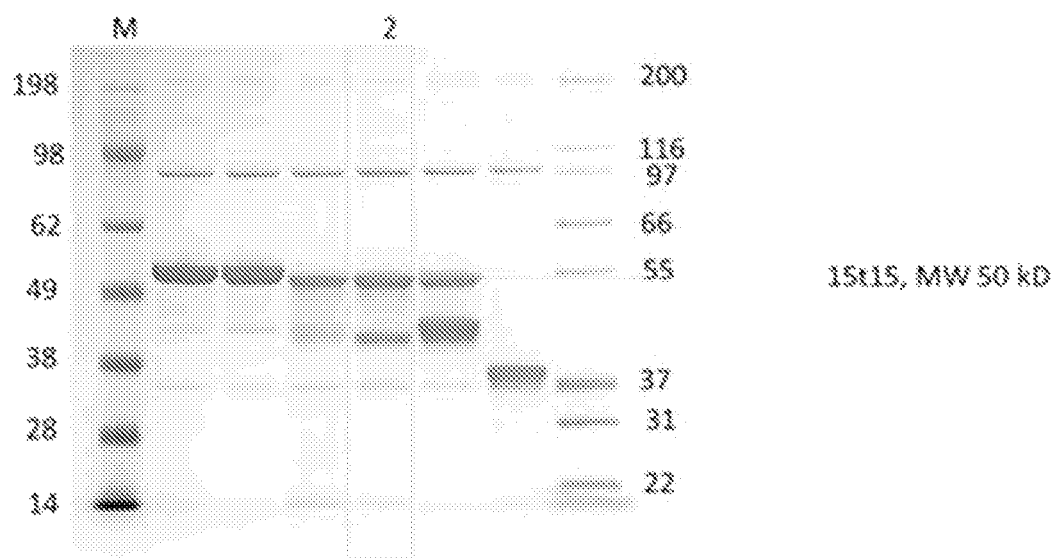

FIGS. 161A and 161B show reduced SDS-PAGE analysis of 15t15 before and after deglycosylation. FIG. 161A shows reduced SDS-PAGE analysis of 15t15 before deglycosylation. FIG. 161B shows reduced SDS-PAGE analysis of 15t15 after deglycosylation.

Figure 162A:
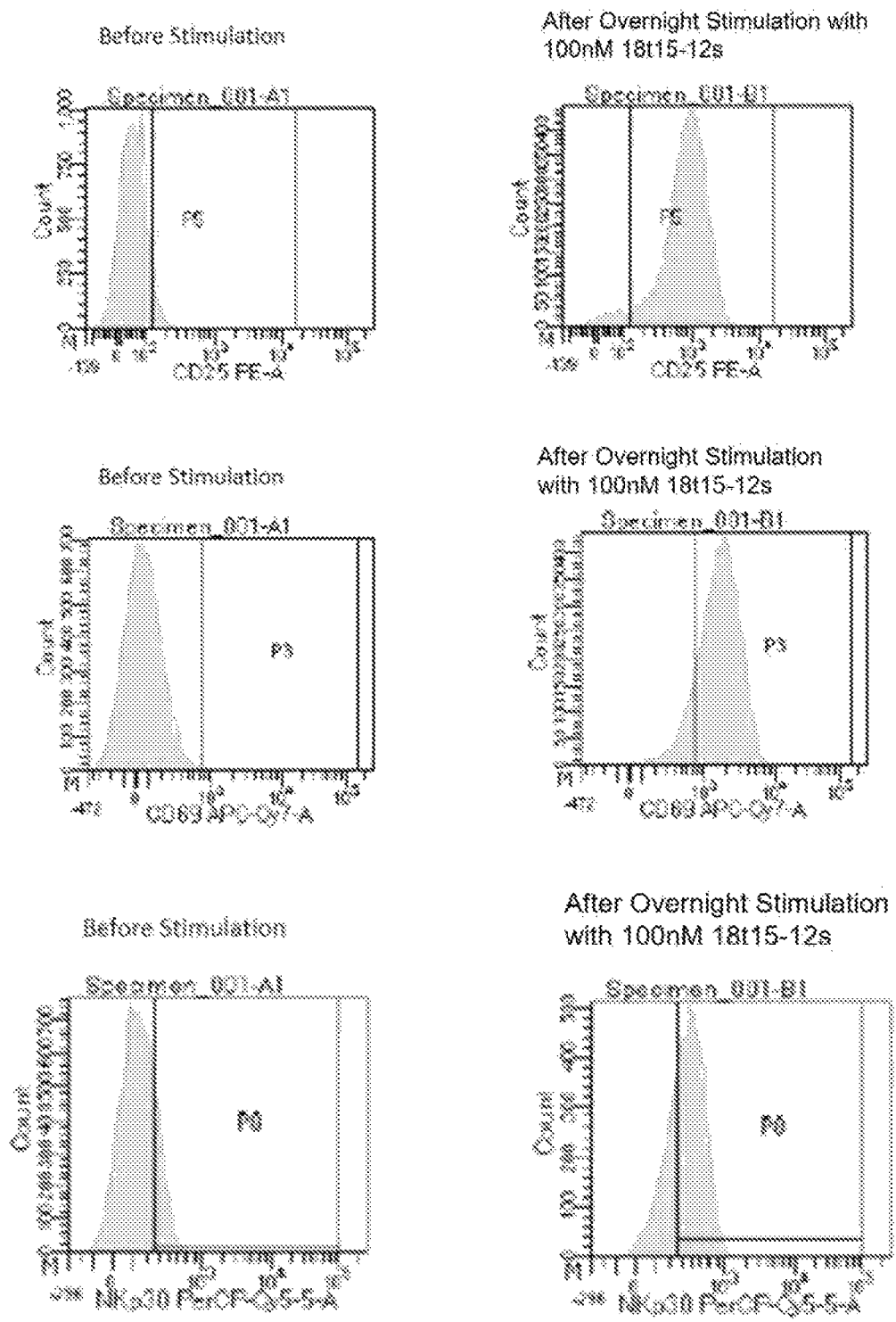
Figure 162B:
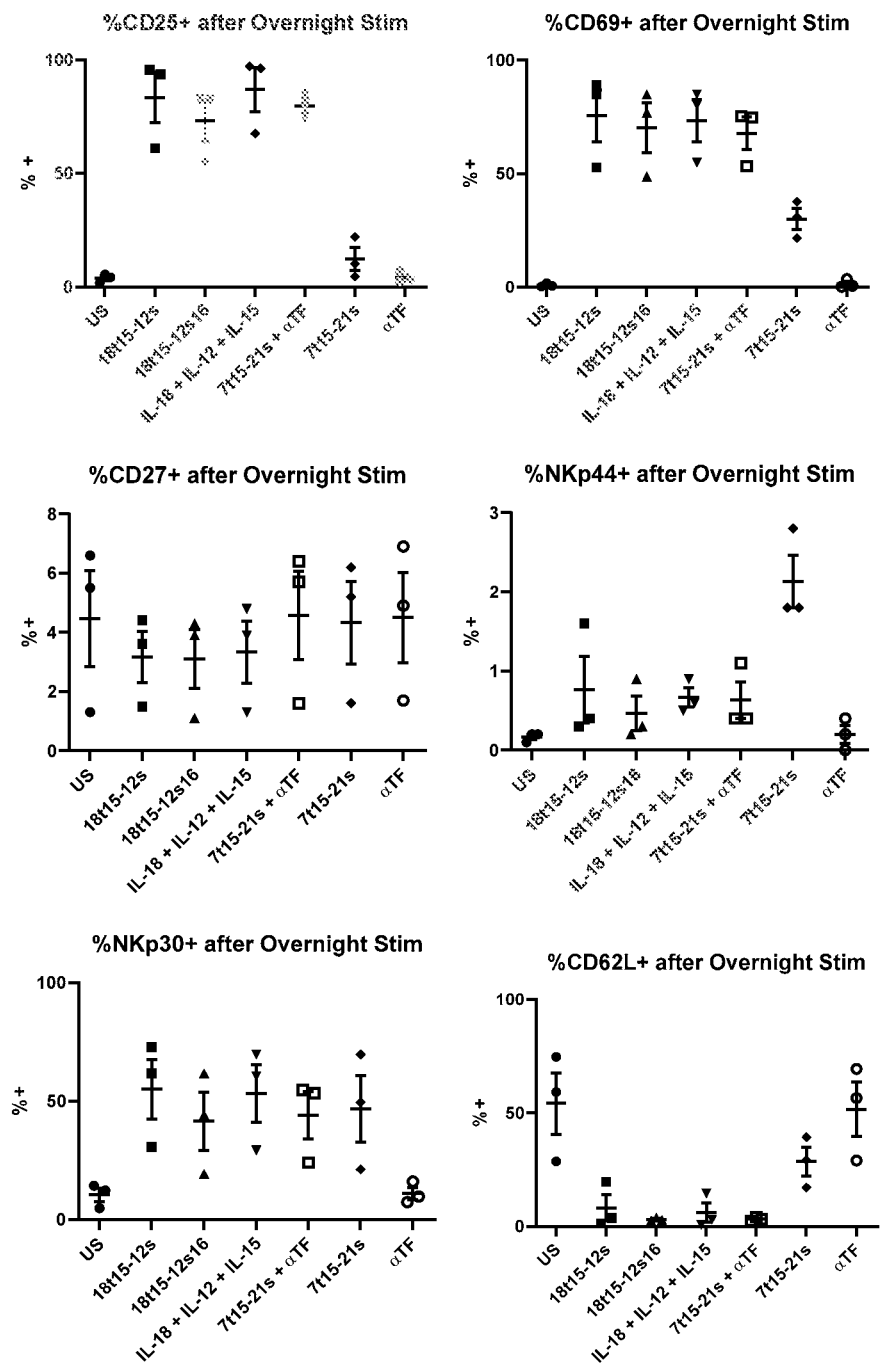

FIGS. 162A and 162B is a set of histograms (FIG. 162A) and a set of graphs (FIG. 162B) showing the change in the surface phenotype of NK cells after stimulation with 18t15-12s, 18t15-12s16, and 7t15-21s+anti-TF antibody.

Figure 163:
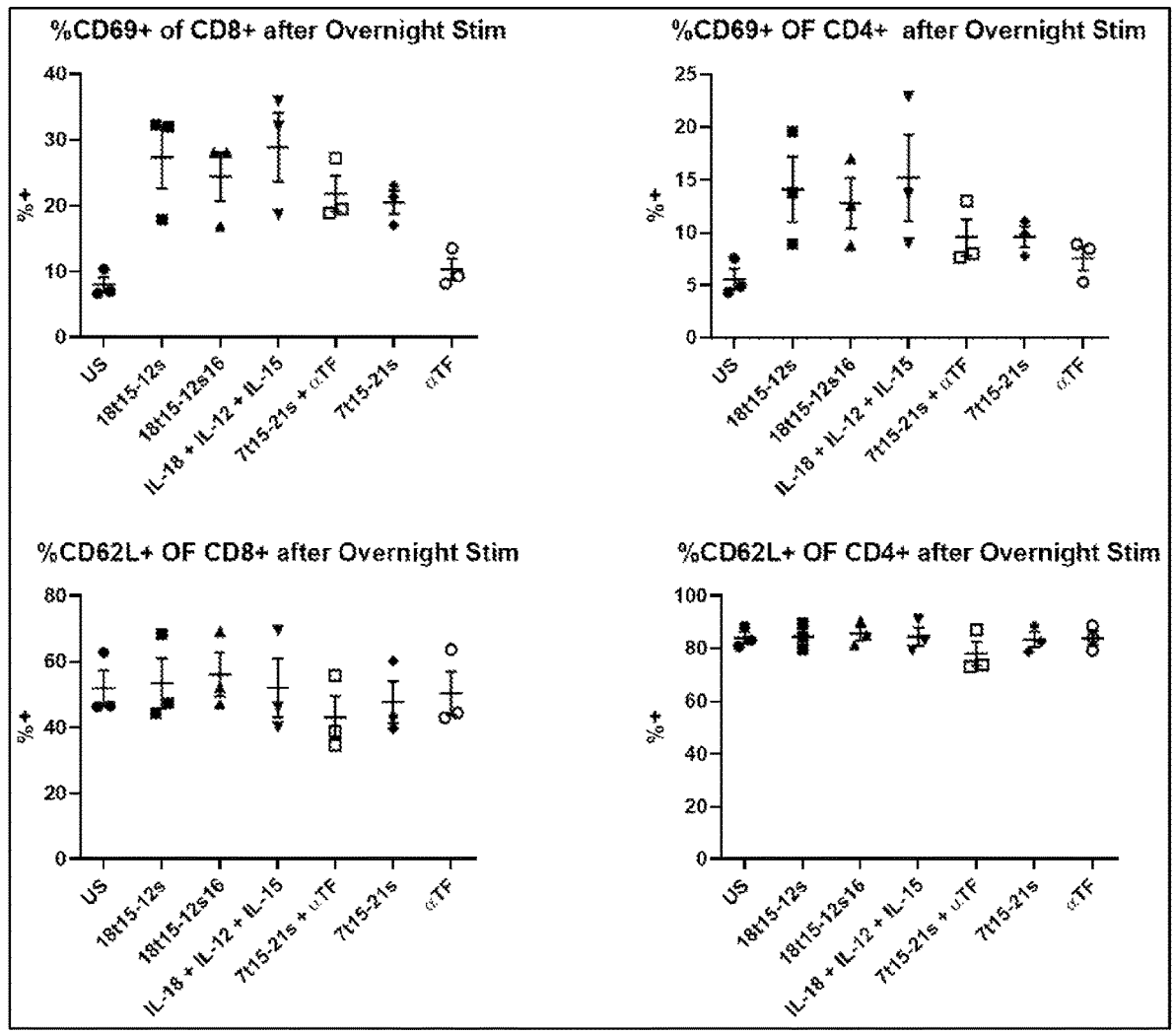

FIG. 163 is a set of graphs showing changes in the surface phenotype of lymphocyte populations after stimulation with 18t15-12s, 18t15-12s16, and 7t15-21s.

Figure 164:
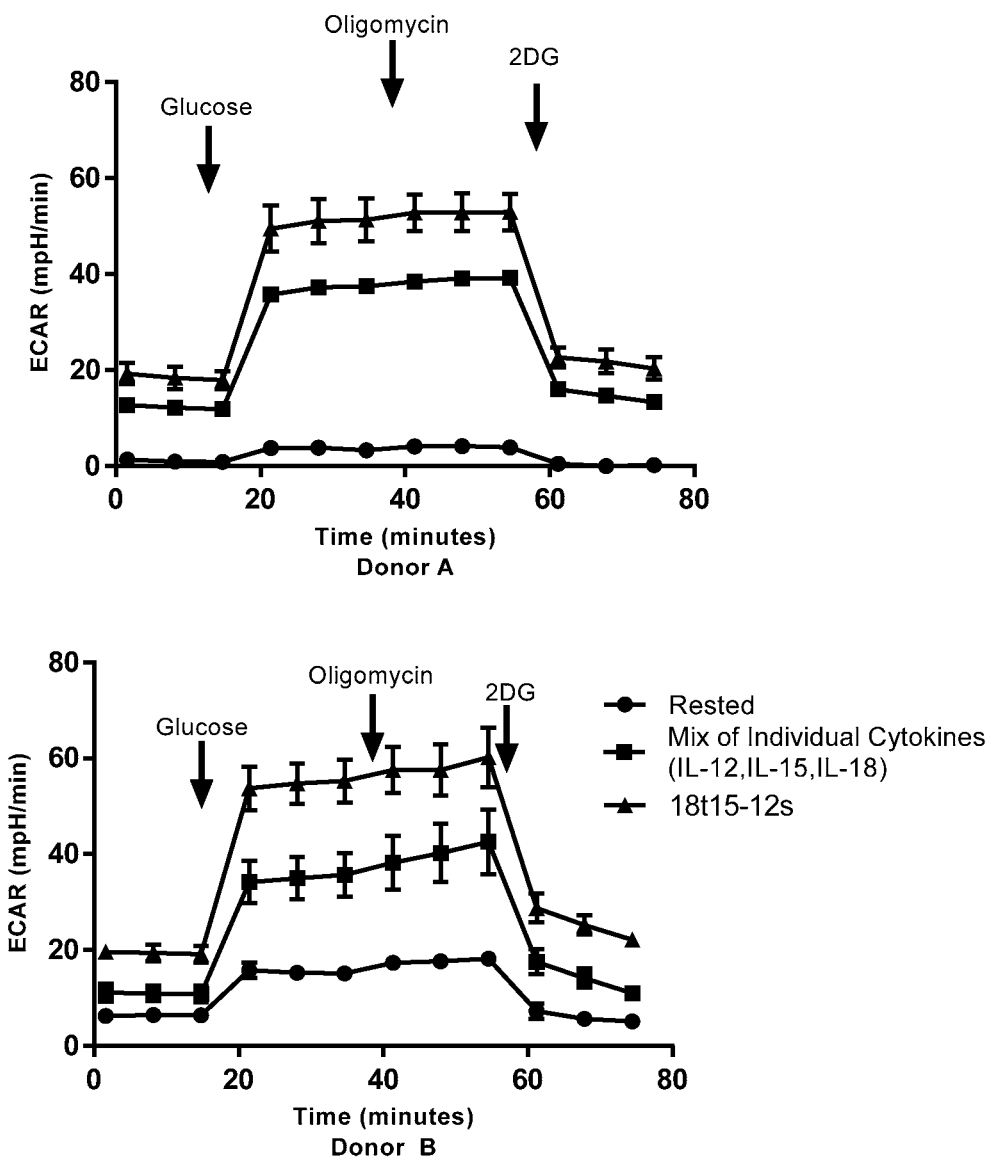

FIG. 164 is a set of graphs showing an increase in glycolysis in NK cells following treatment with 18t15-12s.

Figure 165:
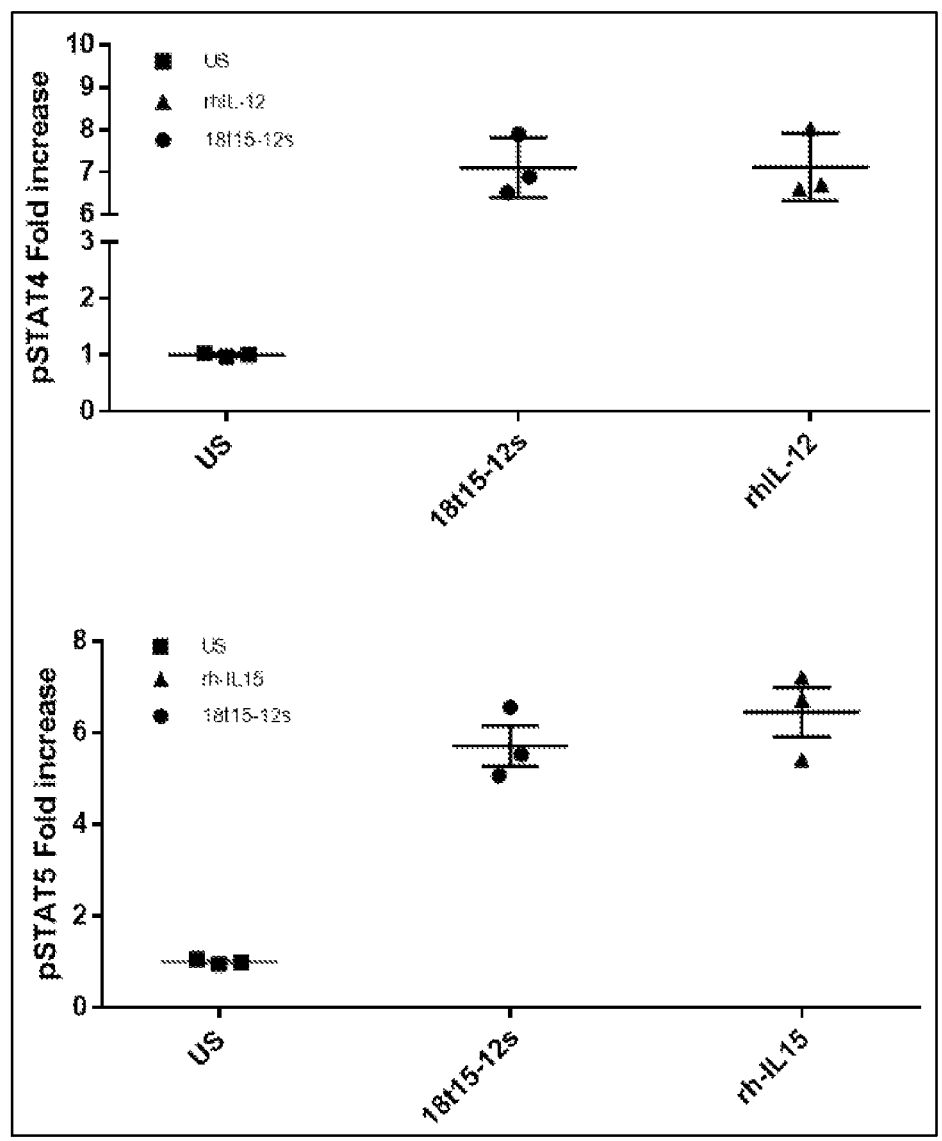

FIG. 165 is a set of graphs showing an increase in phospho-STAT4 and phospho-STAT5 levels in NK cells after stimulation with 18t15-12s.

Figure 166:
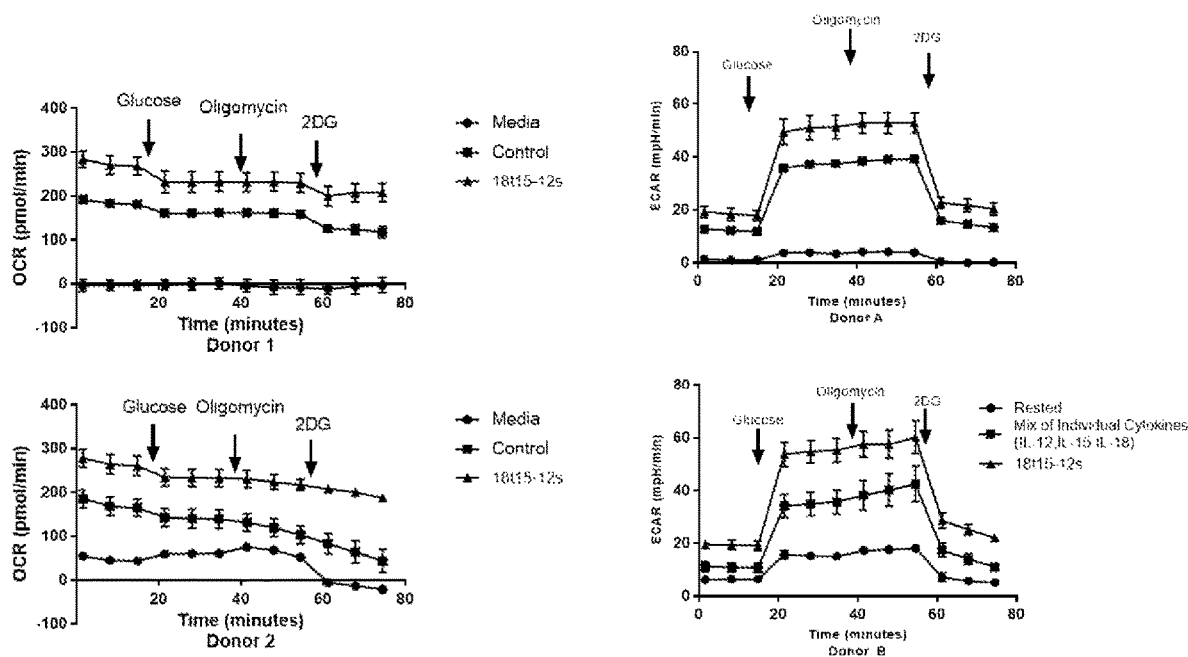

FIG. 166 is a set of graphs showing that overnight stimulation of NK cells with 18t15-12s enhances cell metabolism.

Figure 167A:
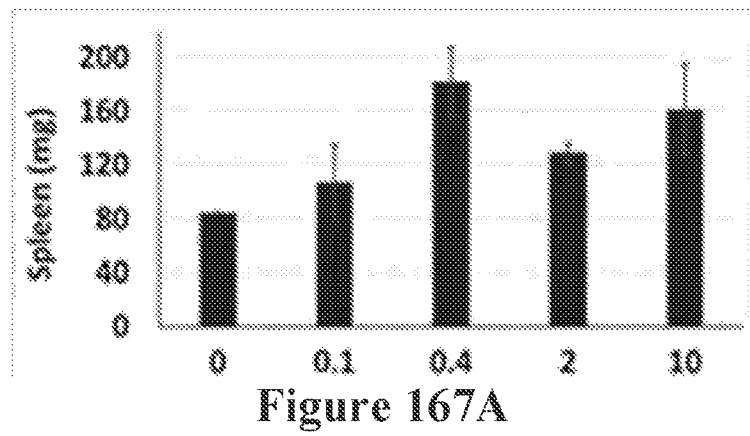
Figure 167B:
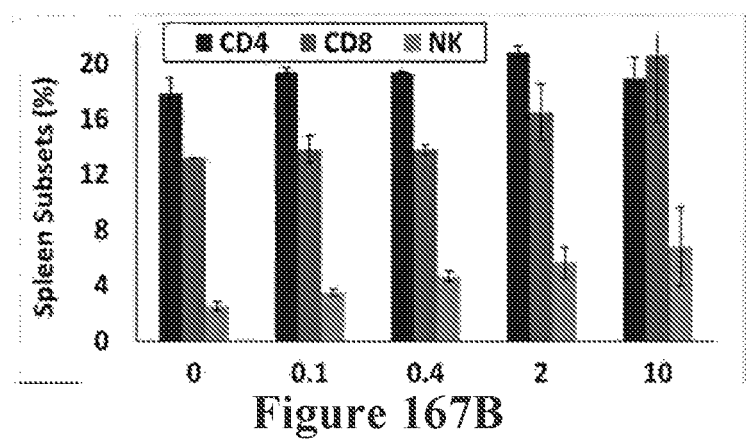
Figure 167C:
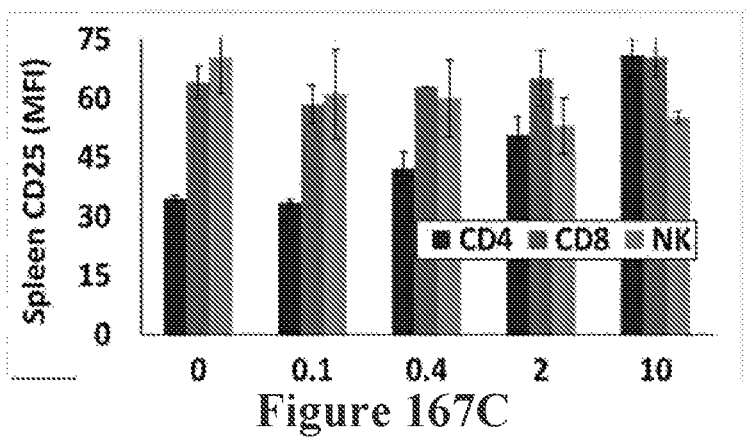

FIG. 167A-C is a set of graphs showing immunostimulation in C57BL/6 mice following treatment with 2t2.

Figure 168A:
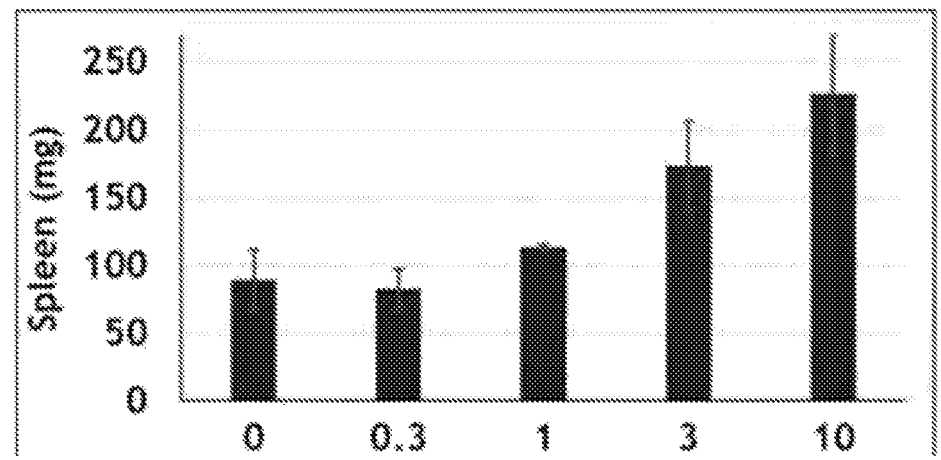
Figure 168B:
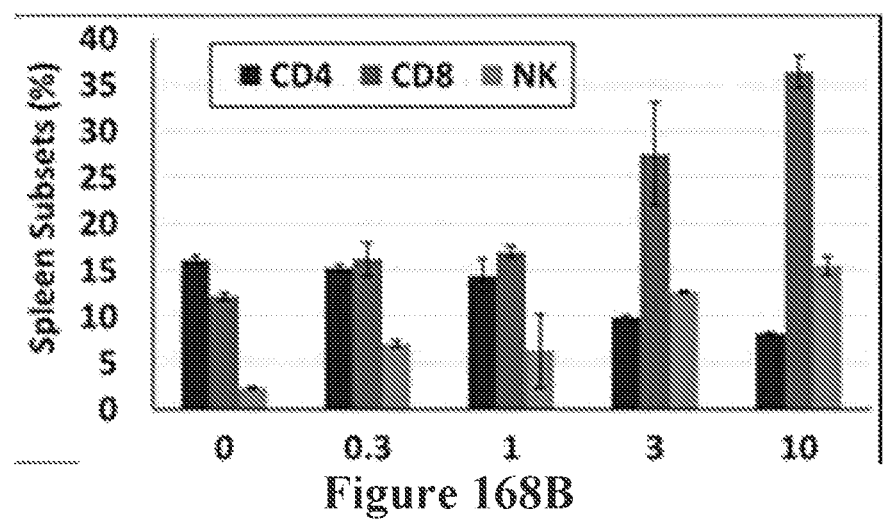

FIG. 168A-B is a set of graphs showing immunostimulation in C57BL/6 mice following treatment with TGFRt15-TGFRs.

Figure 169A:
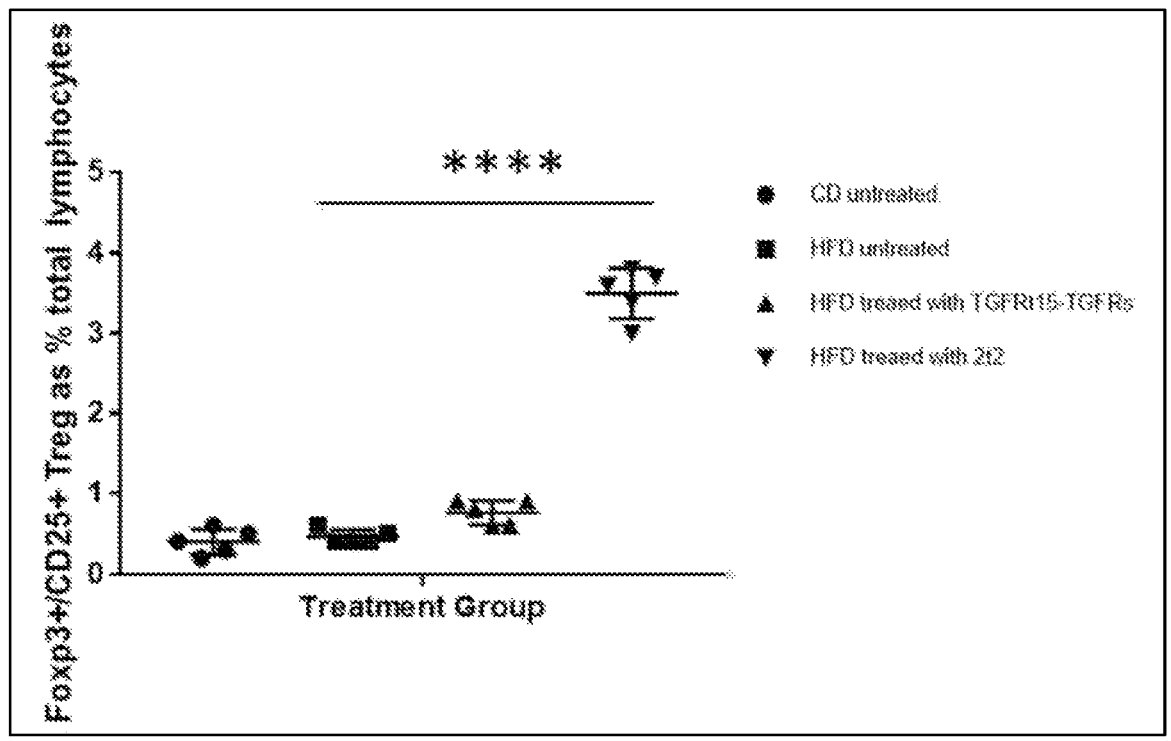
Figure 169B:
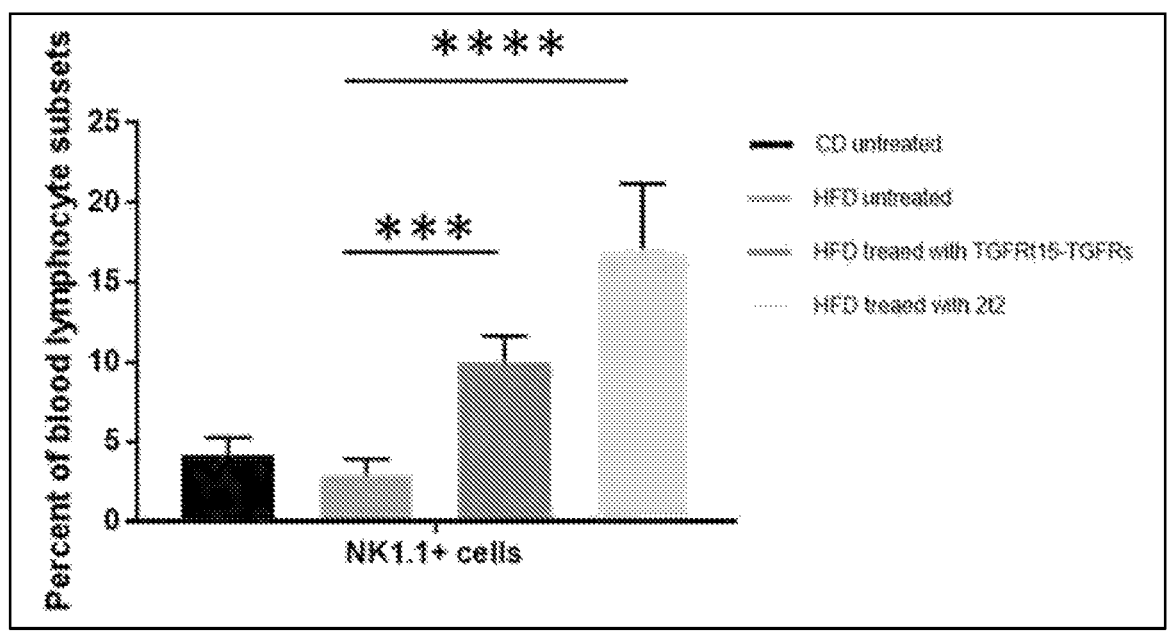
Figure 169C:
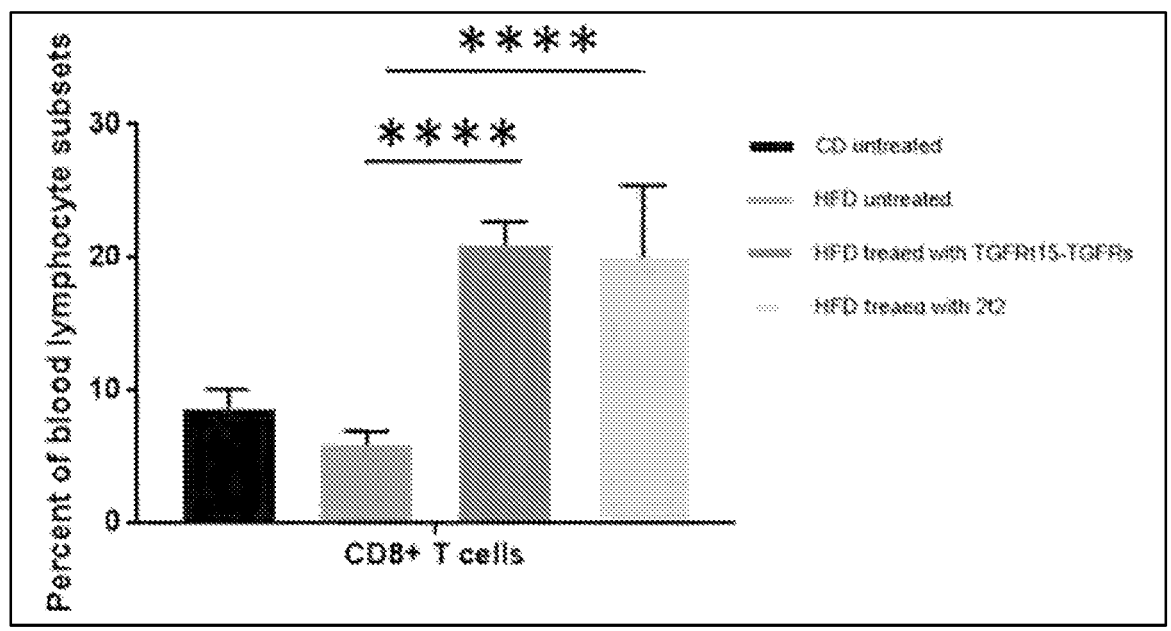

FIG. 169A-C is a set of graphs showing in vivo stimulation of Tregs, NK cells, and CD8$^+$ T cells in ApoE$^{-/-}$ mice fed with a Western diet and treated with TGFRt15-TGFRs or 2t2.

Figure 170A:
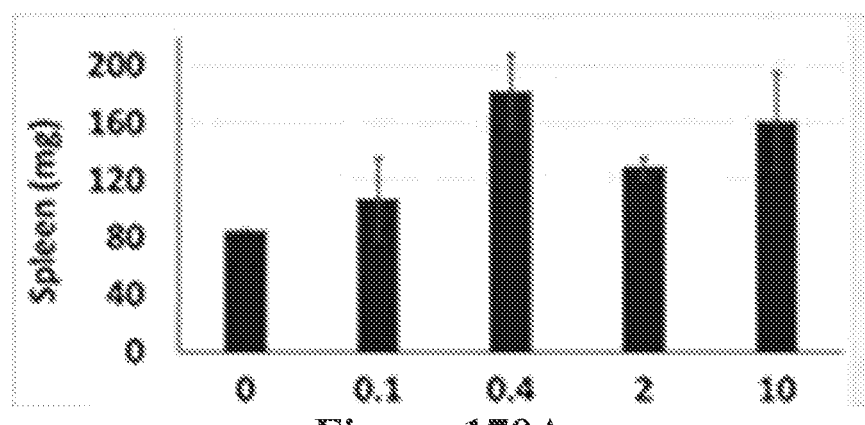
Figure 170B:
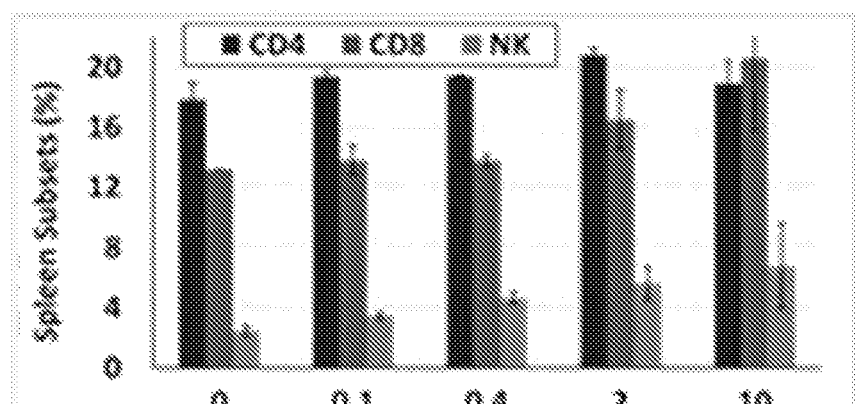

FIG. 170A-B is a set of graphs showing induction of splenocyte proliferation by 2t2 in C57BL/6 mice.

Figure 171A:
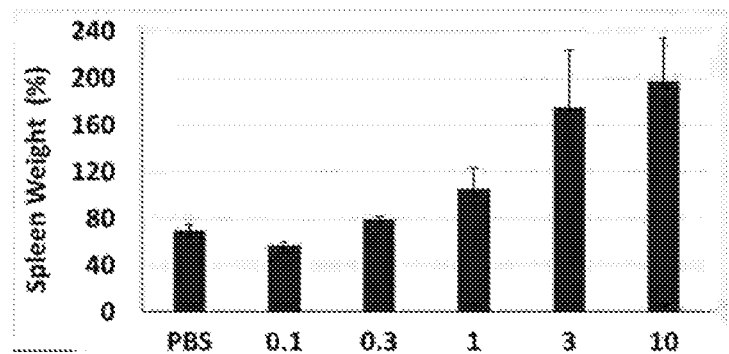
Figure 171B:
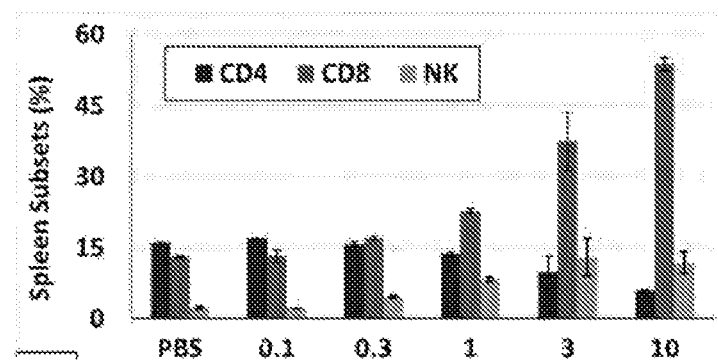
Figure 171C:
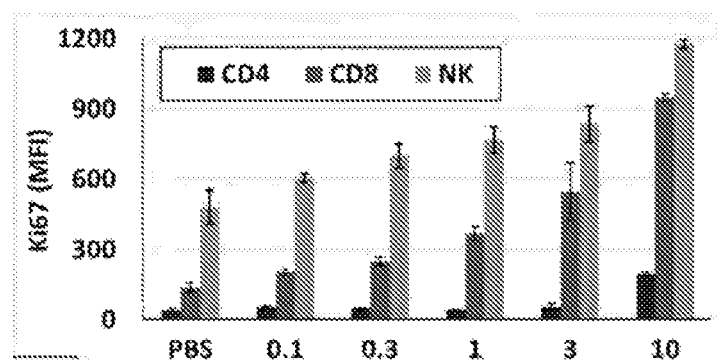

FIG. 171A-C is a set of graphs showing immunostimulation in C57BL/6 mice following treatment with TGFRt15-TGFRs.

Figure 172A:
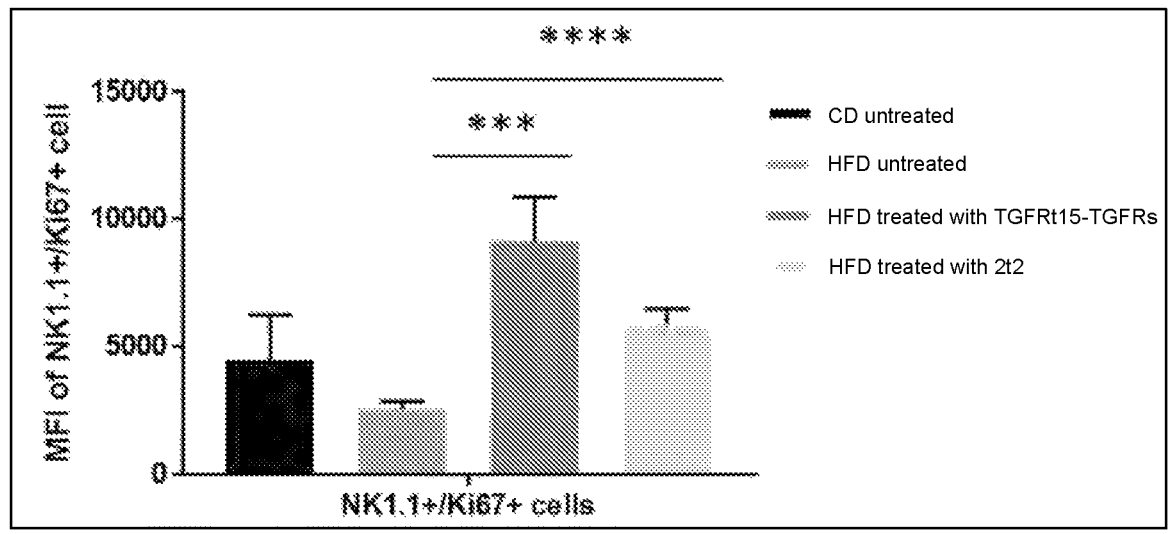
Figure 172B:
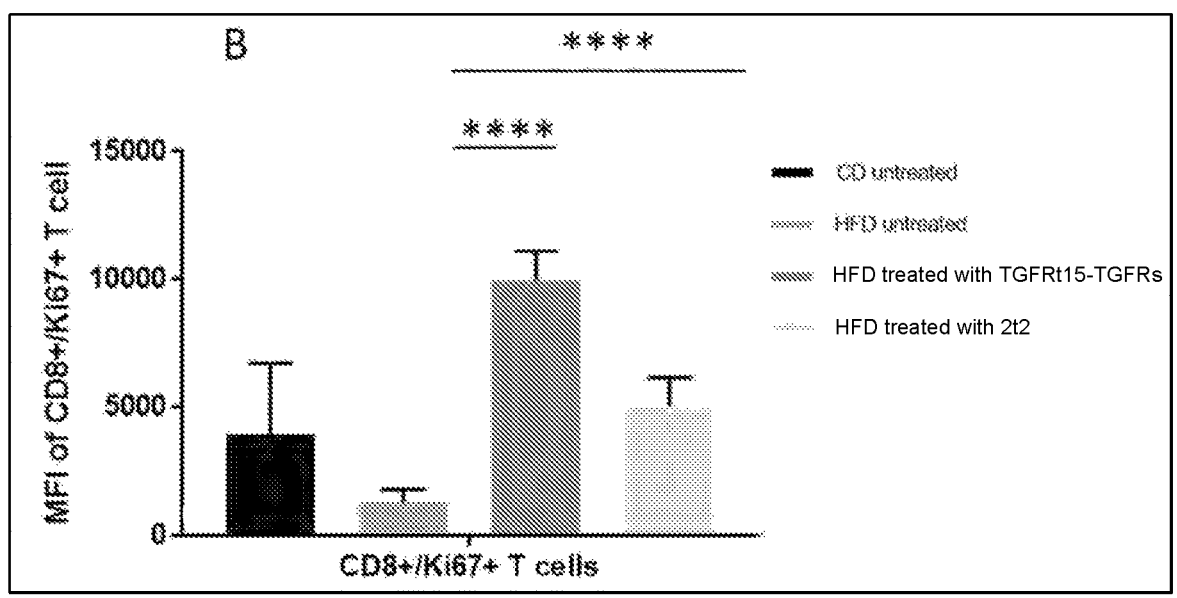

FIG. 172A-B is a set of graphs showing in vivo induction of proliferation of NK cells and CD8$^+$ T cells in ApoE$^{-/-}$ mice fed with a Western diet and treated with TGFRt15-TGFRs or 2t2.

Figure 173:
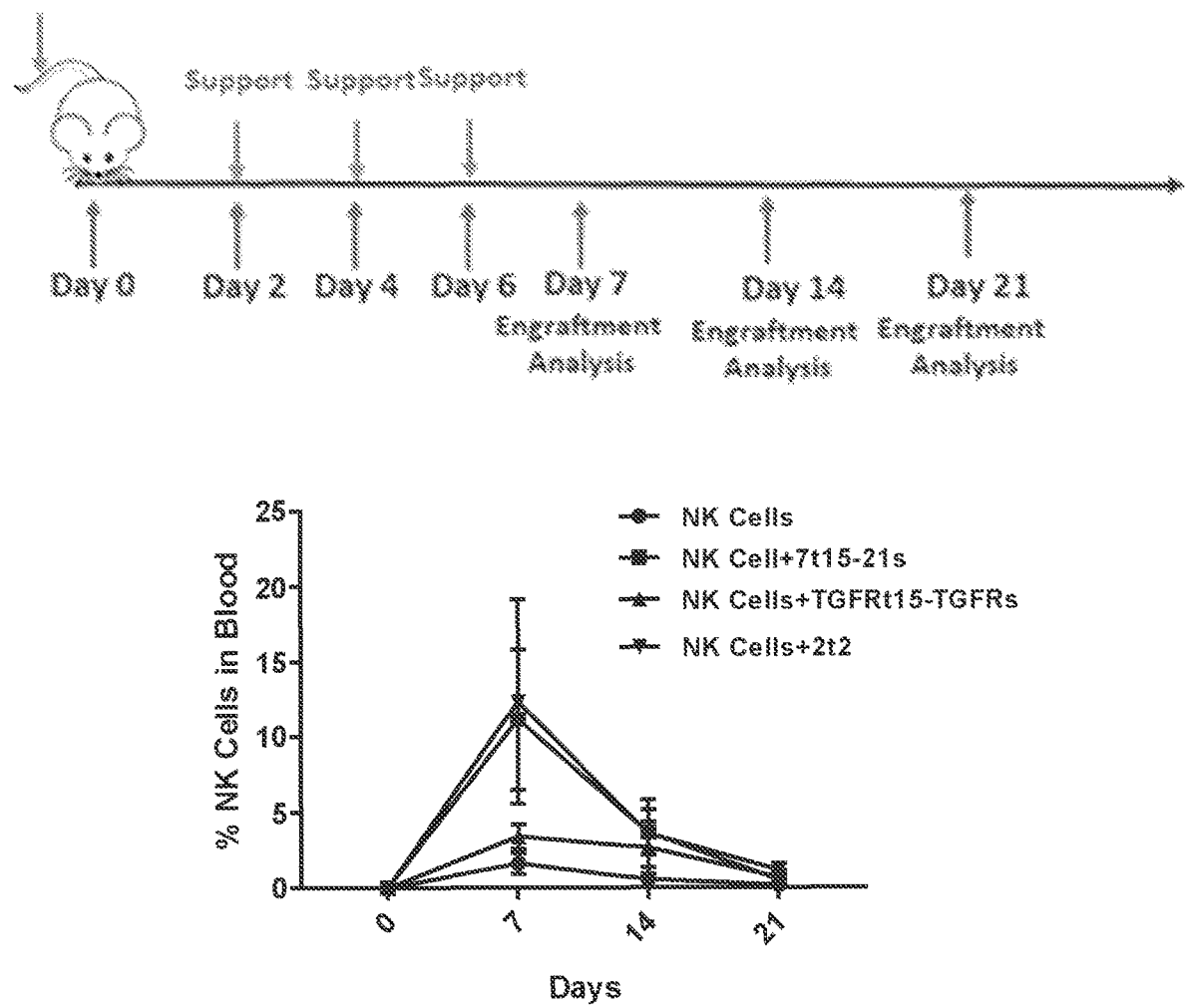

FIG. 173 is a schematic and a set of graphs showing the persistence of 7t15-21s and anti-TF antibody-expanded NK cells in NSG mice following treatment with 7t15-21, TGFRt15-TGFRs or 2t2.

Figure 174A:
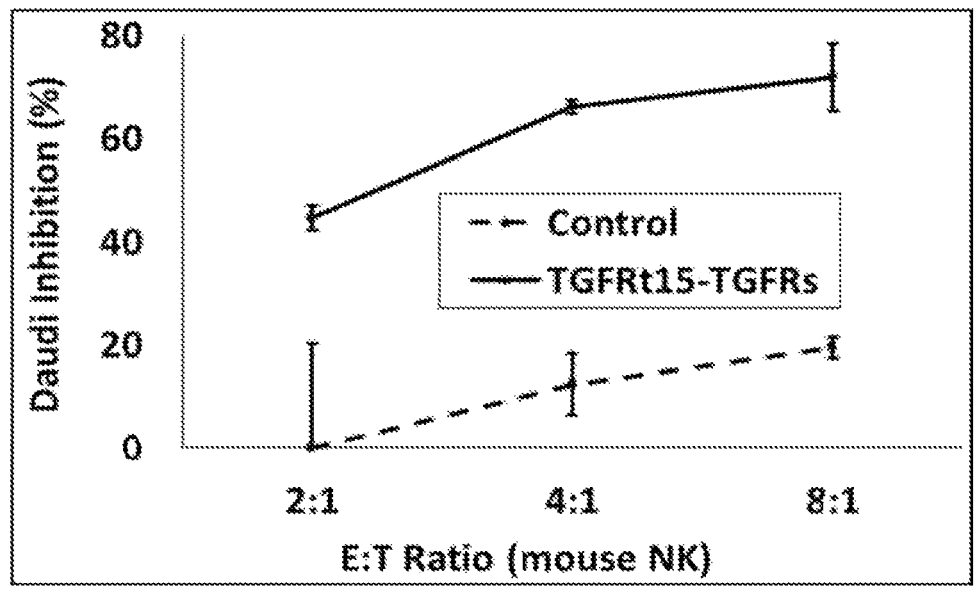
Figure 174B:
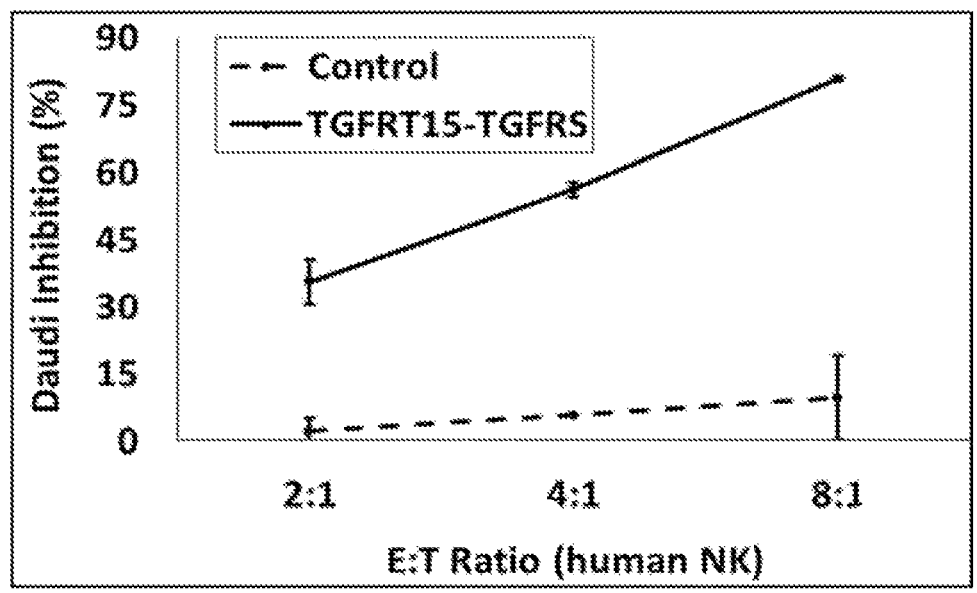

FIG. 174A-B is a set of graphs showing enhancement of cytotoxicity of NK cells following treatment of NK cells with TGFRt15-TGFRs.

Figure 175A:
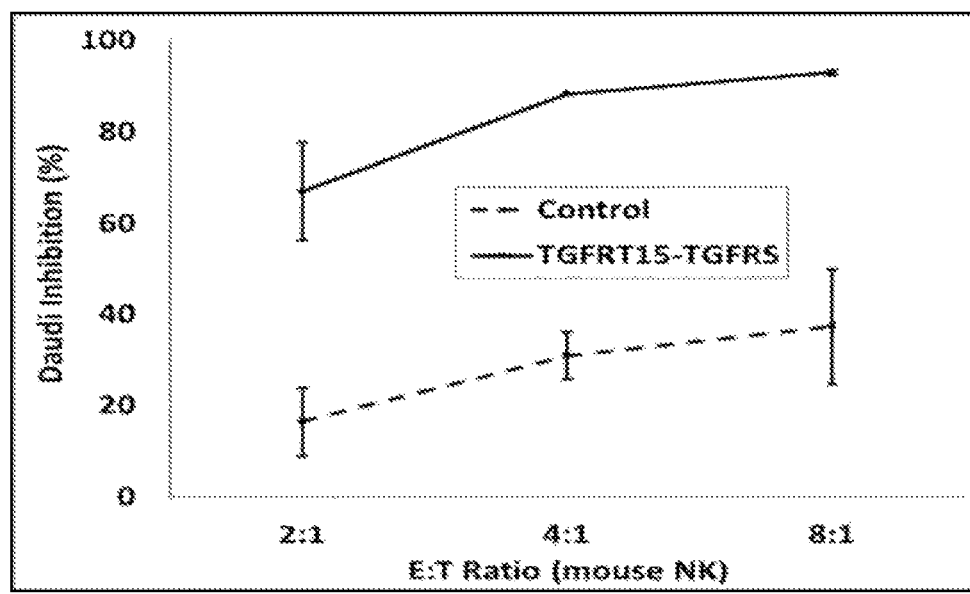
Figure 175B:
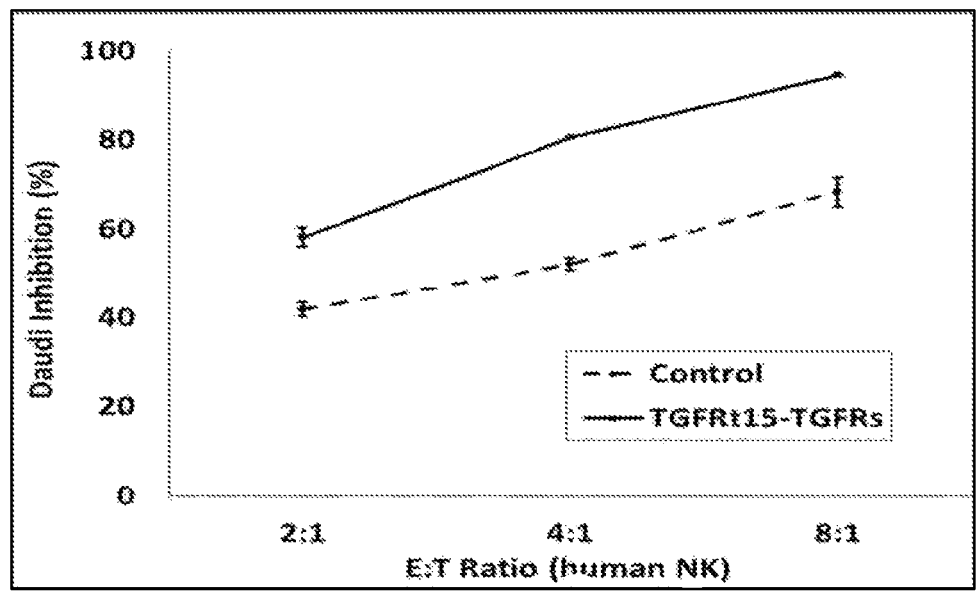

FIG. 175A-B is a set of graphs showing enhancement of ADCC activity of NK cells following treatment of NK cells with TGFRt15-TGFRs.

Figure 176:
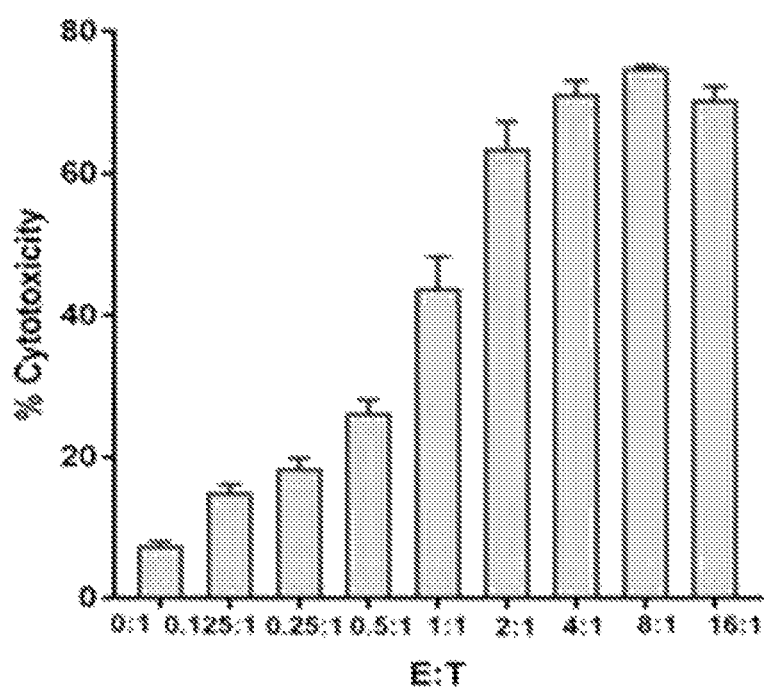

FIG. 176 is a graph of in vitro killing of senescent B16F10 melanoma cells by TGFRt15-TGFRs/2t2-activated mouse NK cells.

FIG. 177A-H is a set of graphs showing antitumor activity of TGFRt15-TGFRs plus anti-TRP1 antibody (TA99) in combination with chemotherapy in a melanoma mouse model.

Figure 178A:
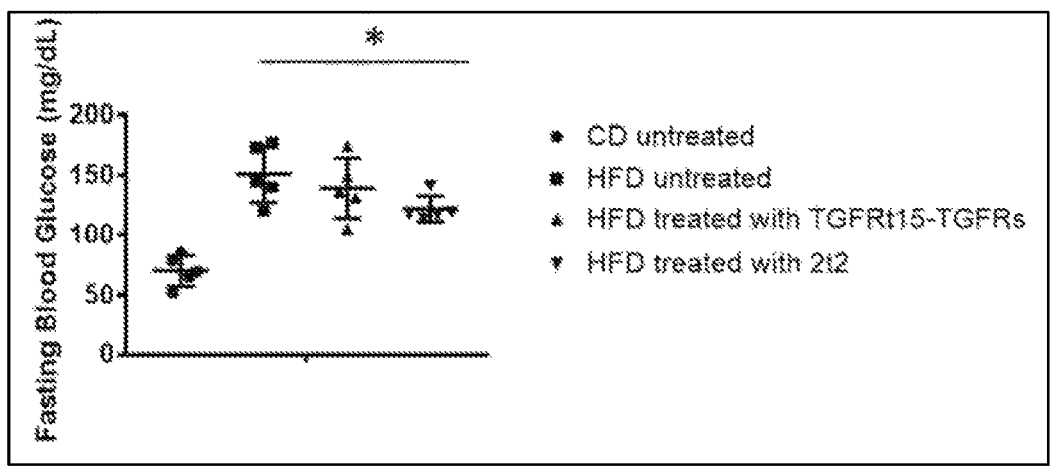
Figure 178B:
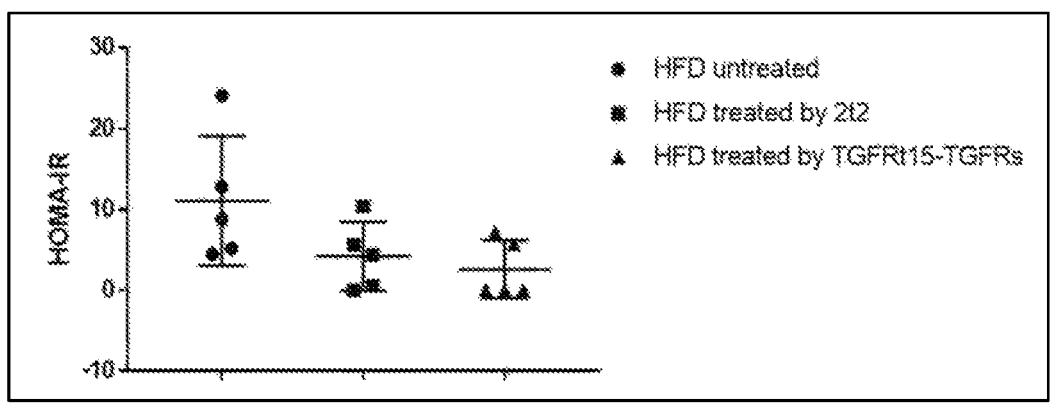
Figure 178C:
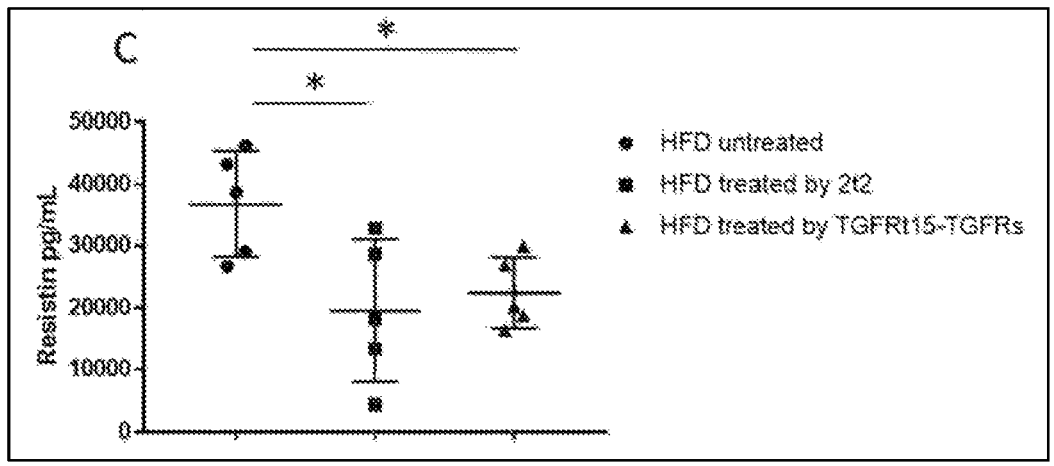

FIG. 178A-C is a set of graphs showing amelioration of the Western diet-induced hyperglycemia in ApoE$^{-/-}$ mice by 2t2.

Figure 179:
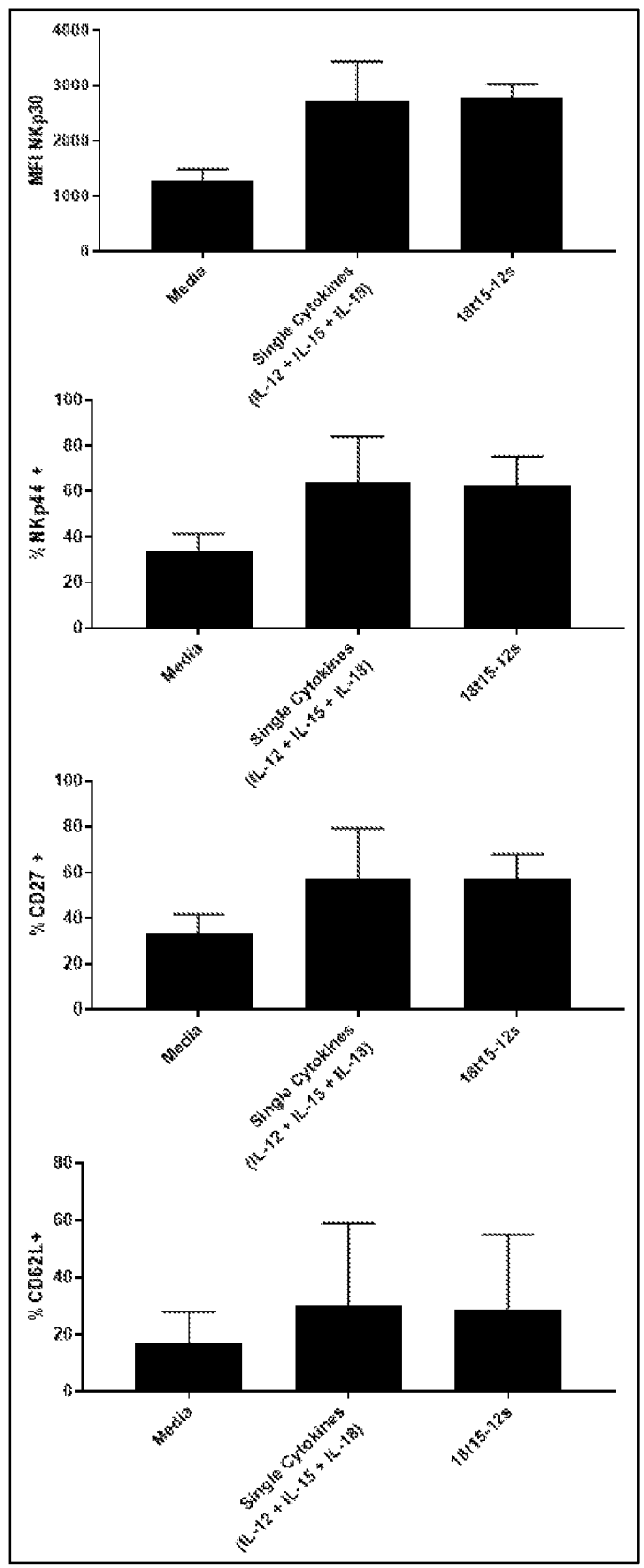

FIG. 179 is a set of graphs showing cell surface staining summarizing the differentiation of NK cells into cytokine-induced memory like NK cells (CIML-NK Cells) after stimulation with 18t15-12s and cultured in rhIL-15.

Figure 180:
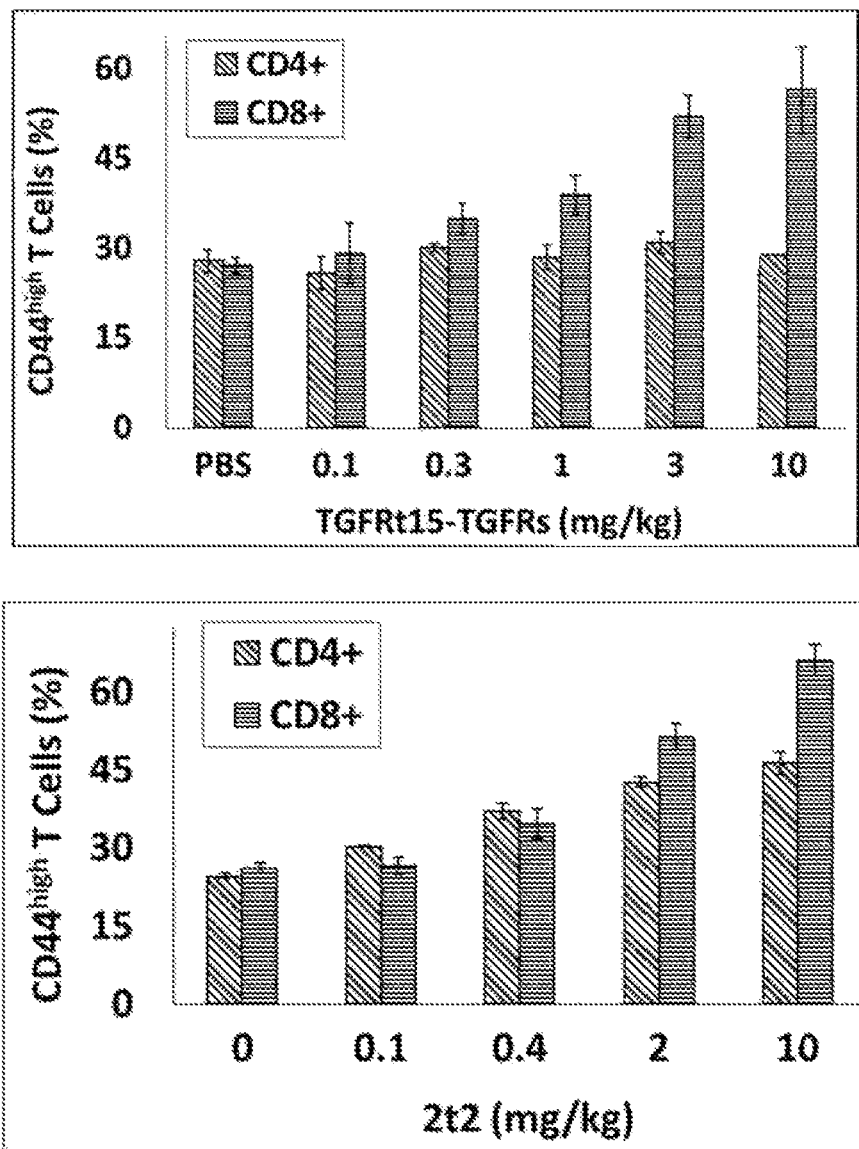

FIG. 180 shows upregulation of CD44 memory T cells. The upper panel shows upregulation of CD44 memory T cells upon treatment with TGFRt15-TGFRs. The lower panel shows upregulation of CD44 memory T cells upon treatment with 2t2.

Figure 181A:
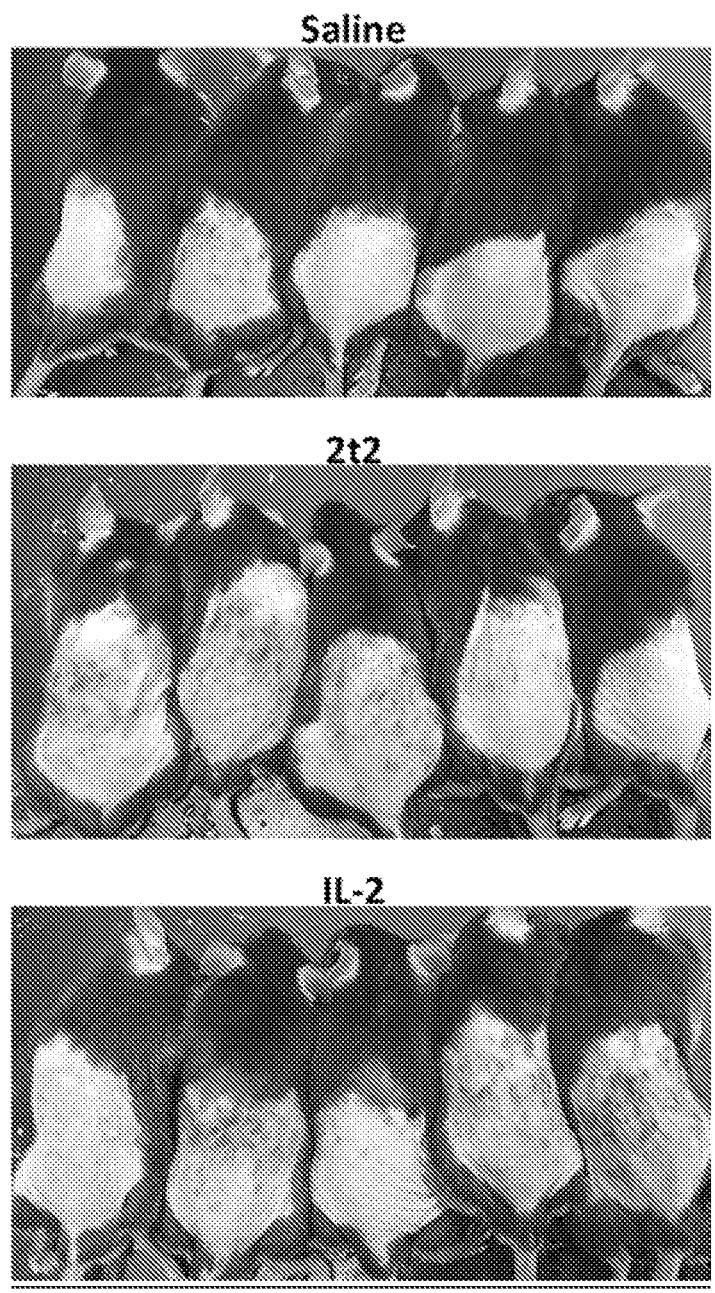
Figure 181B:
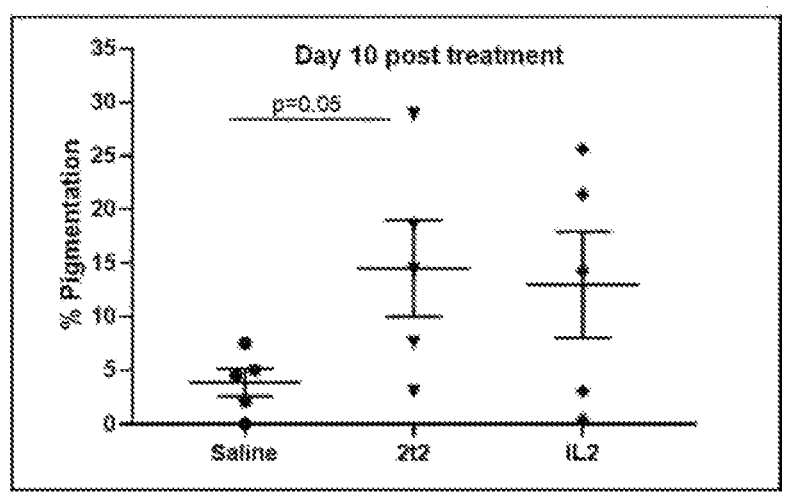

FIGS. 181A and 181B show improvement in hair regrowth following depilation in mice treated with 2t2 or IL-2. FIG. 181A shows skin pigmentation 10 days after depilation in PBS-, 2t2-, or IL-2-treated mice. FIG. 181B shows percent pigmentation in PBS-, 2t2-, or IL-2-treated mice as analyzed using the ImageJ software.

Figure 182:
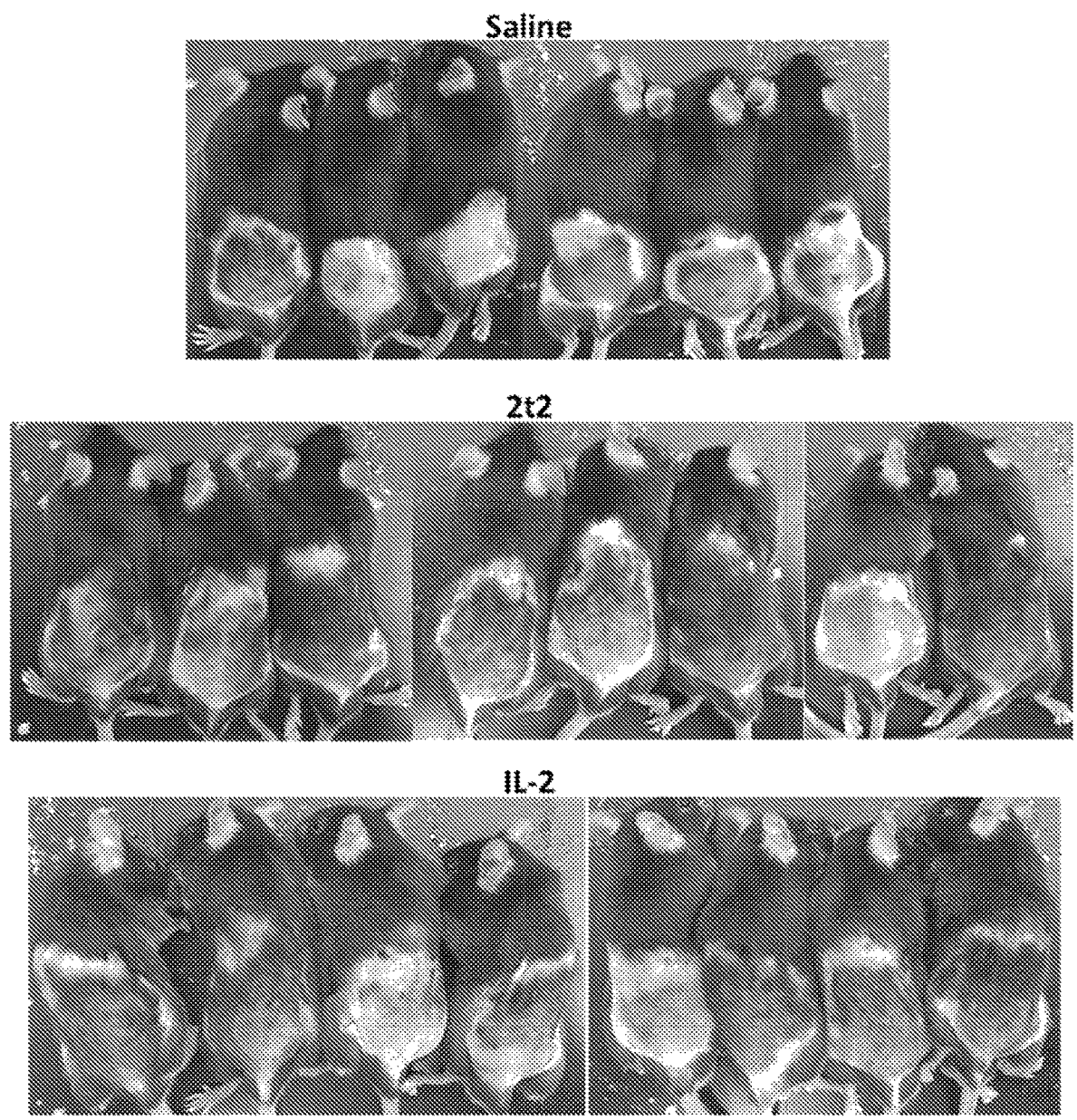

FIG. 182 shows skin pigmentation 14 days after depilation in PBS-, 2t2-, or IL-2-treated mice.

Figure 183:
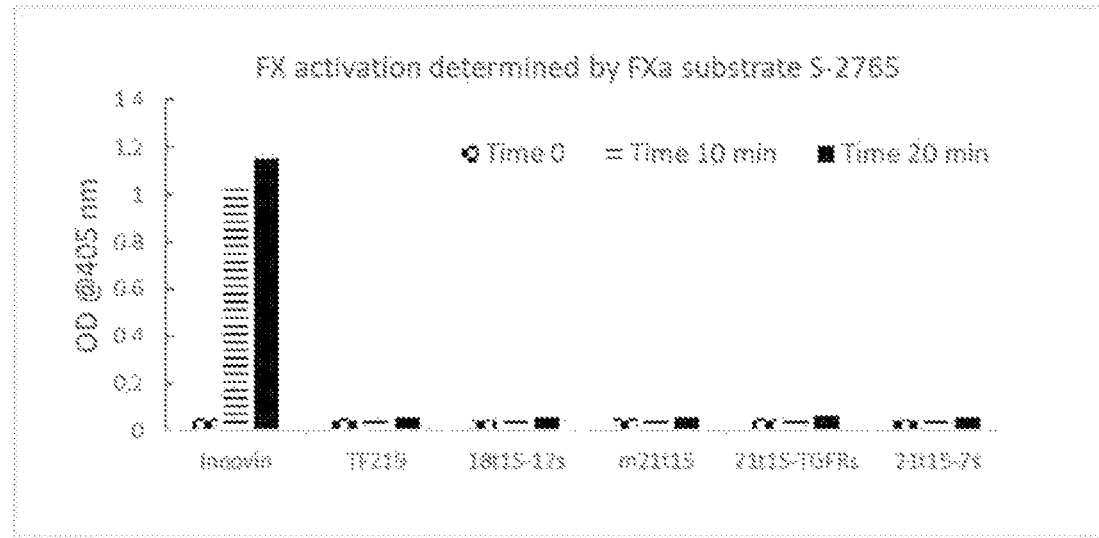

FIG. 183 shows a graph of Factor X (FX) activation following treatment with single-chain or multi-chain chimeric polypeptides.

Figure 184:
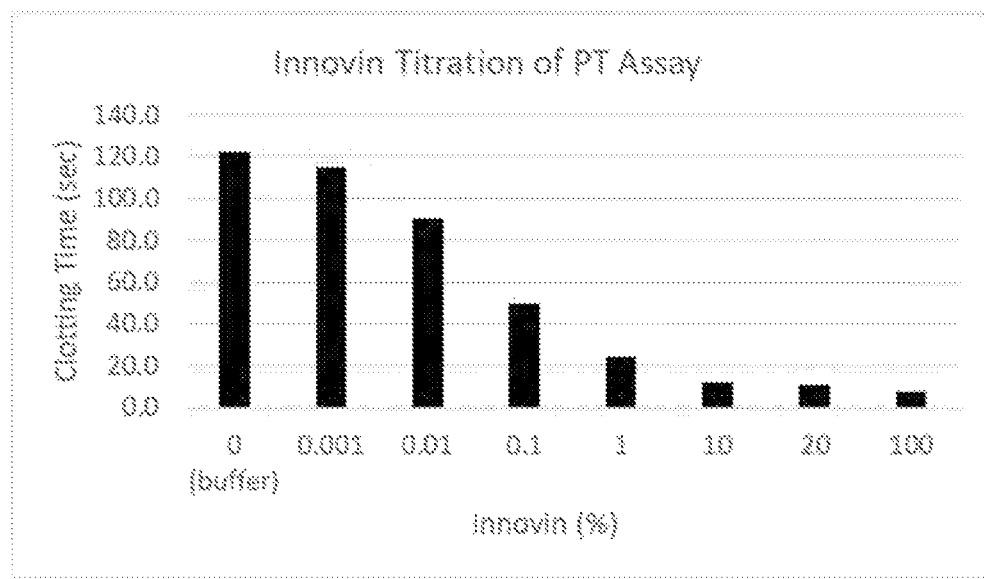

FIG. 184 shows clotting time for a buffer with varying concentrations of Innovin in a prothrombin time (PT) test.

Figure 185:
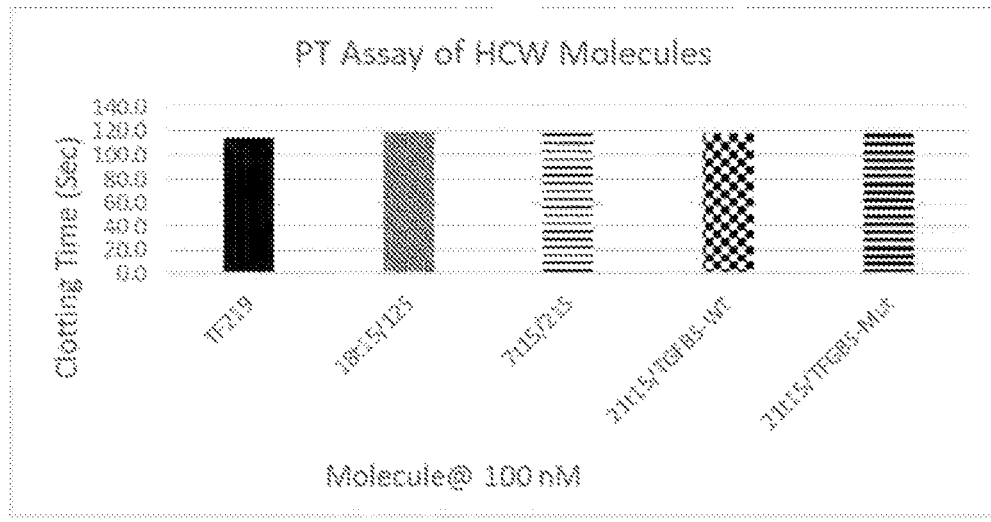

FIG. 185 shows clotting time for multi-chain chimeric polypeptides in a PT Assay.

Figure 186:
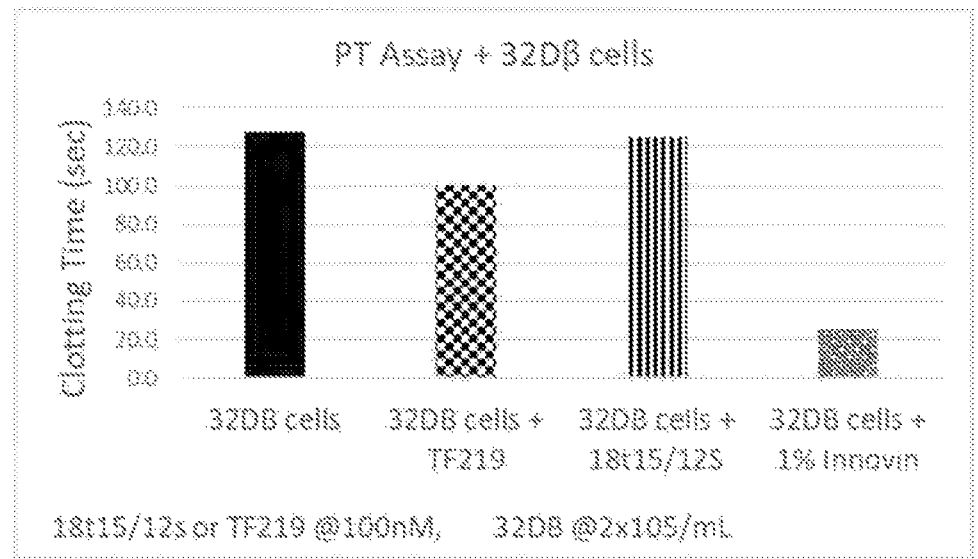

FIG. 186 shows clotting time of the multi-chain chimeric polypeptides in a PT assay when mixed with 32DB cells.

Figure 187:
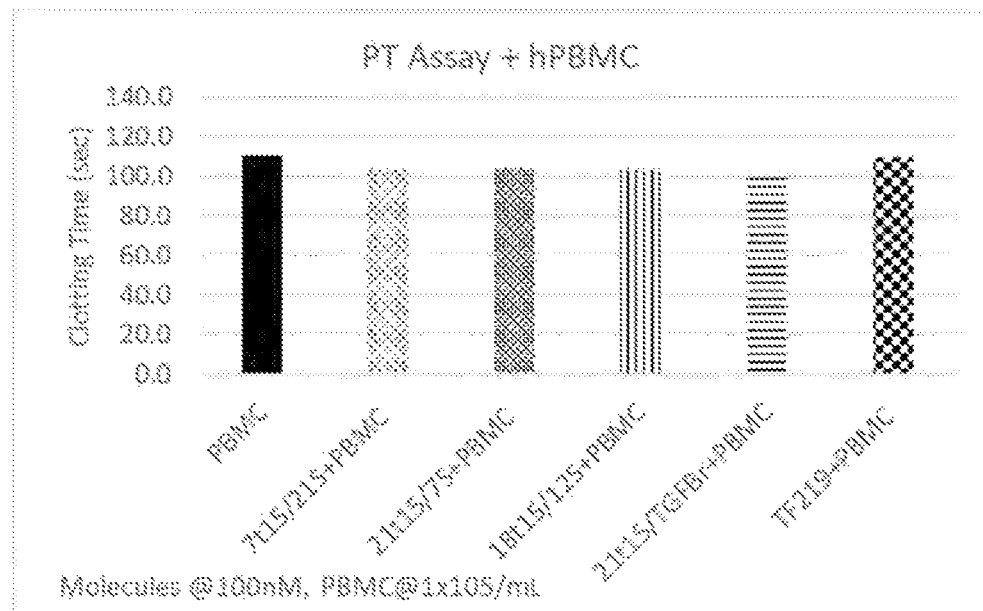

FIG. 187 shows clotting time of multi-chain chimeric polypeptides in a PT assay when mixed with human PBMC.

Figure 188:
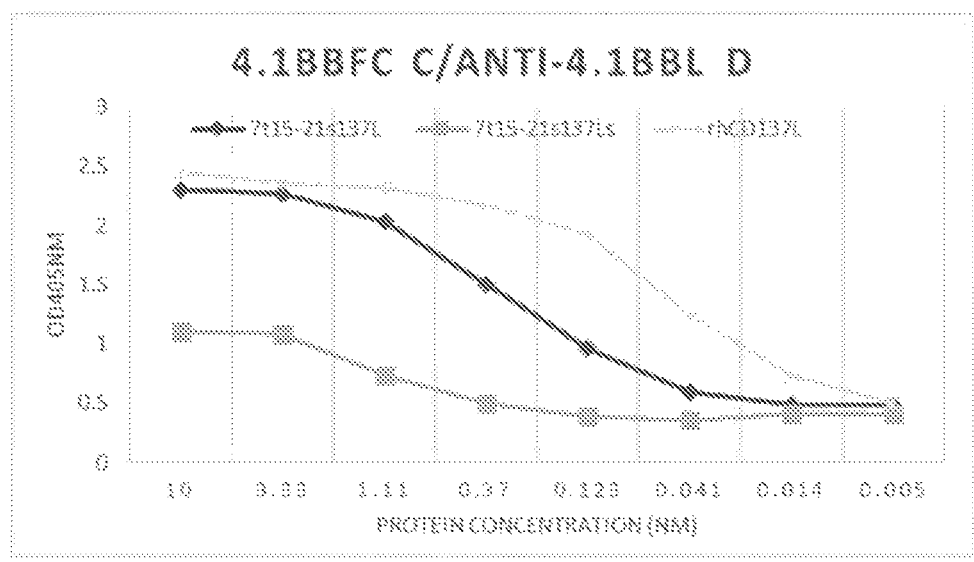
Figure 189A:
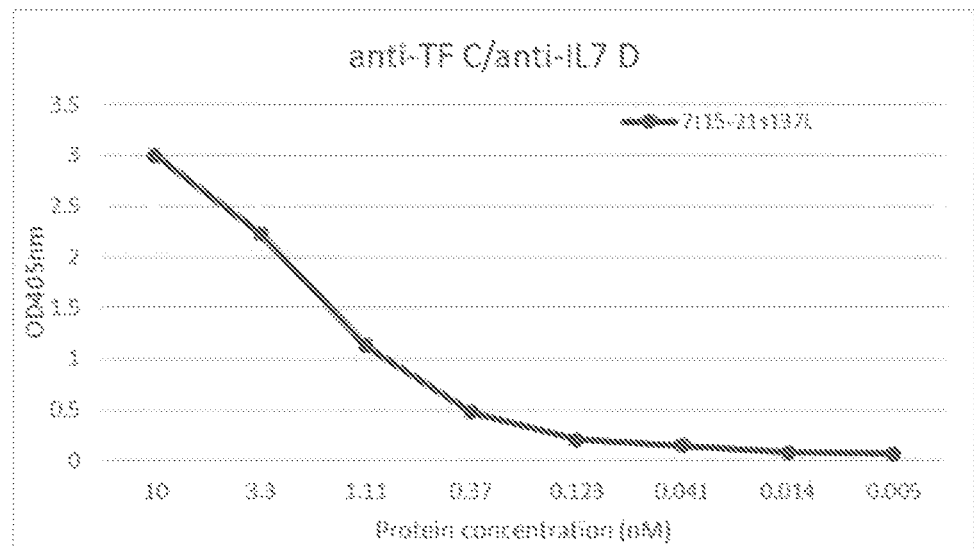
Figure 189B:
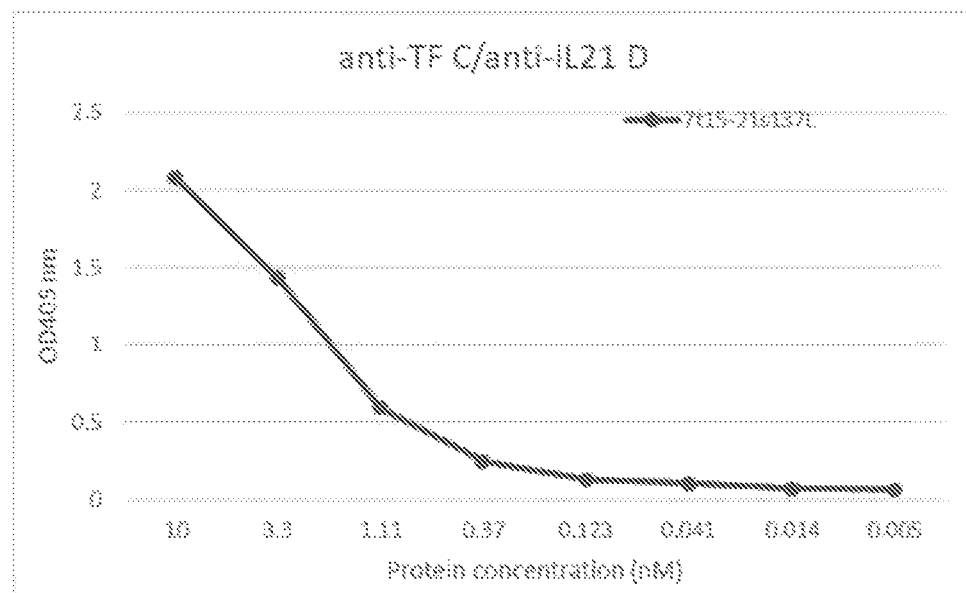
Figure 189C:
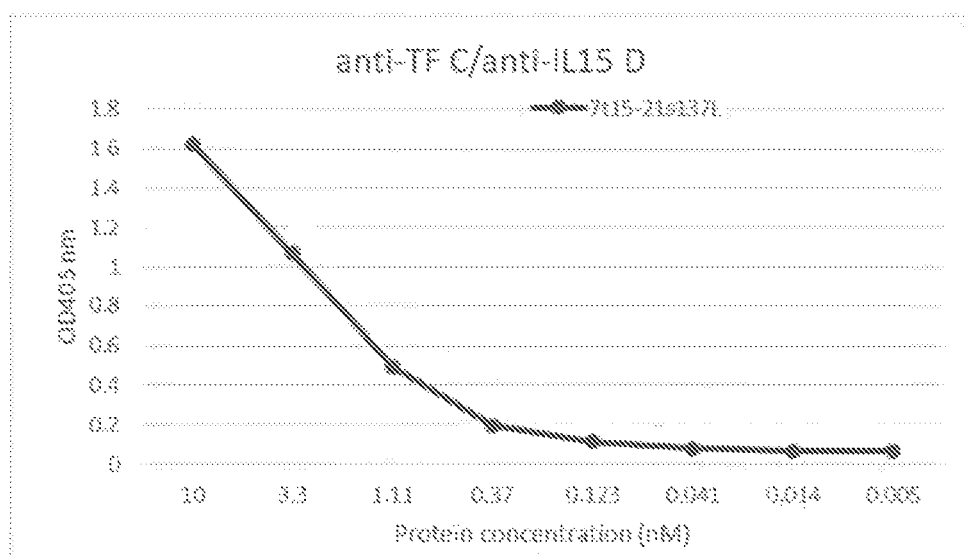
Figure 189D:
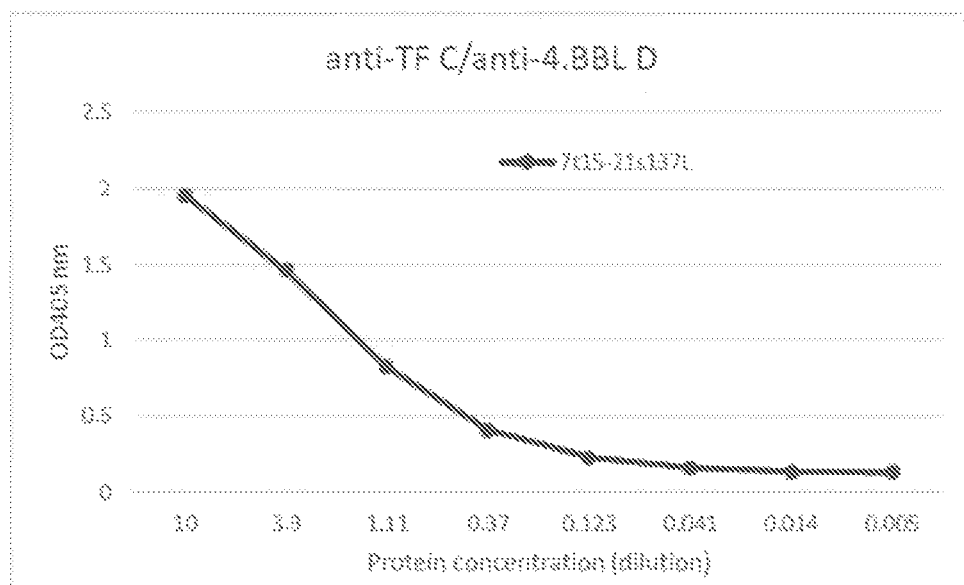

FIG. 188 shows binding of 7t15-21s137L (long version) and 7t15-21s137L (short version) to CD137 (4.1BB).

FIG. 189A-189D show detection of IL7, IL21, IL15, and 4.1BBL in 7t15-21s137L (long version) by the respective antibodies using ELISA.

Figure 190:
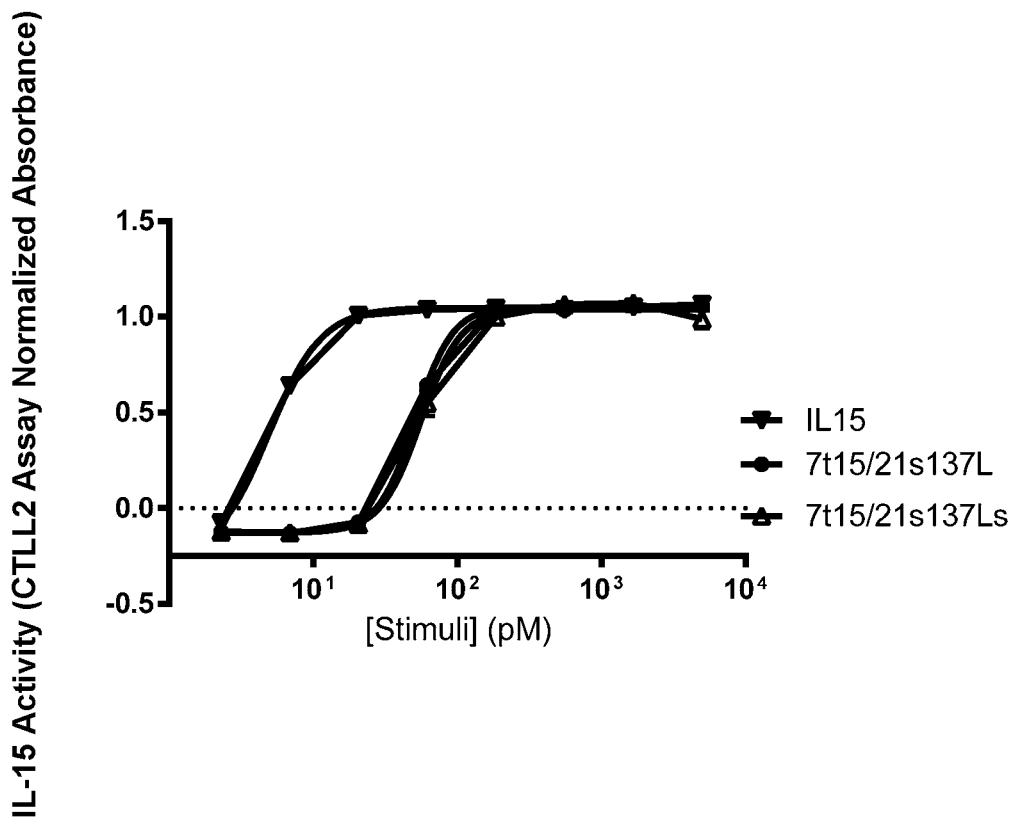

FIG. 190 shows IL-15 activity of 7t15-21s137L (long version) and 7t15-21s137L (short version) as evaluated by an IL2Rαβγ-containing CTLL2 cell proliferation assay.

Figure 191:
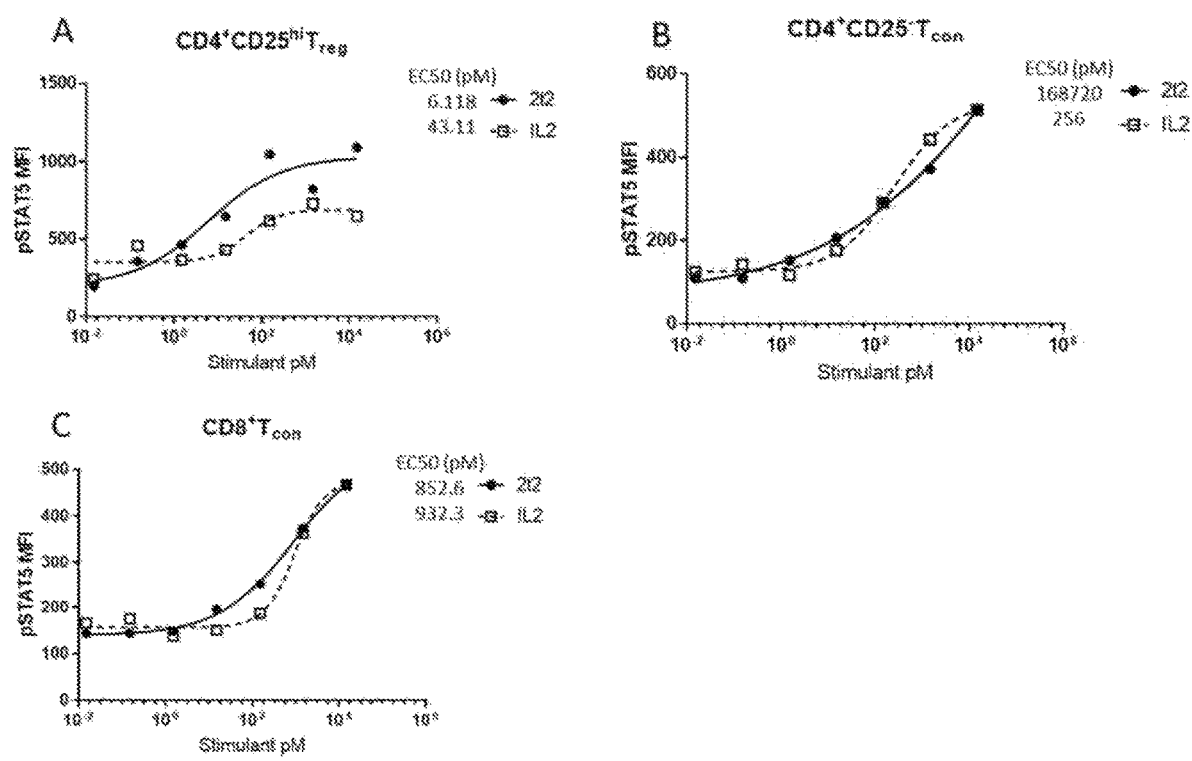

FIGS. 191A-191C show human blood lymphocyte pStat5a responses in $CD4^+CD25^{hi}T_{reg}$ cells, $CD4^+CD25^-T_{con}$ cells, or in $CD8^+$ $T_{con}$ cells in response to 2t2 or IL2 treatment. FIG. 191A shows pSTAT5 responses in $CD4^+CD25^{hi}T_{reg}$ cells. Figure C191B shows pSTAT5 responses in $CD4^+CD25^-T_{con}$ cells. FIG. 191C shows pSTAT5 responses in $CD8^+$ $T_{con}$ cells.

Figure 192:
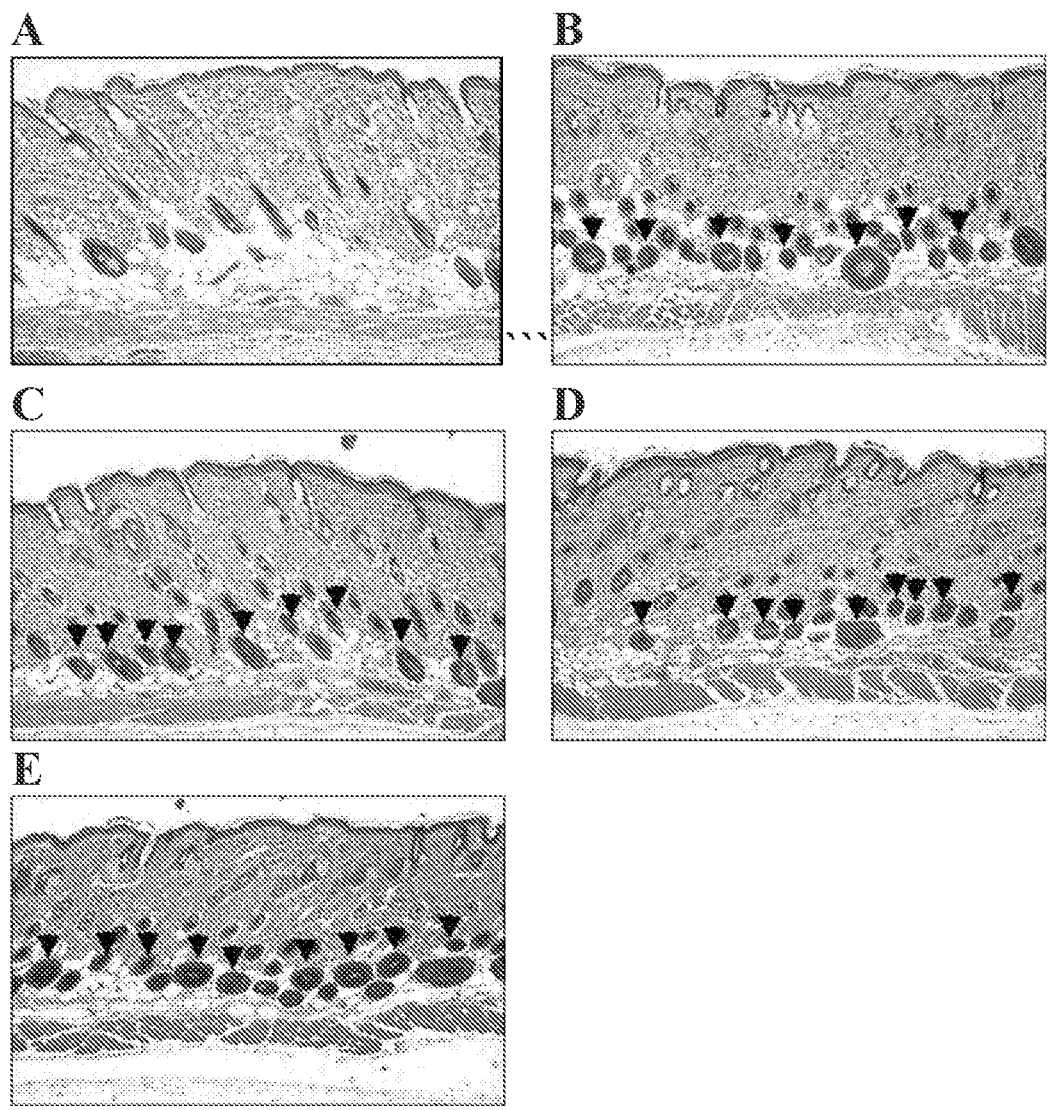

FIGS. 192A-192E is a set of imaging showing that treatment with an IL-2 based molecule (2t2) can induce formation of hair follicles following depilation in mouse model. FIG. 192A is an image from a control mouse-only depilation done after hair was shaved, FIG. 192B is an image from a mouse where depilation was followed by low dose IL-2 (1 mg/kg) administration, and FIGS. 192C-192E show images from mice where depilation was followed by 2t2 at 0.3 mg/kg, (FIG. 192C), 1 mg/kg (FIG. 192D), and (FIG. 192E) 3 mg/kg. Black arrows indicate anagen-phase hair follicles that will later extend into dermis and facilitate hair growth.

Figure 193:
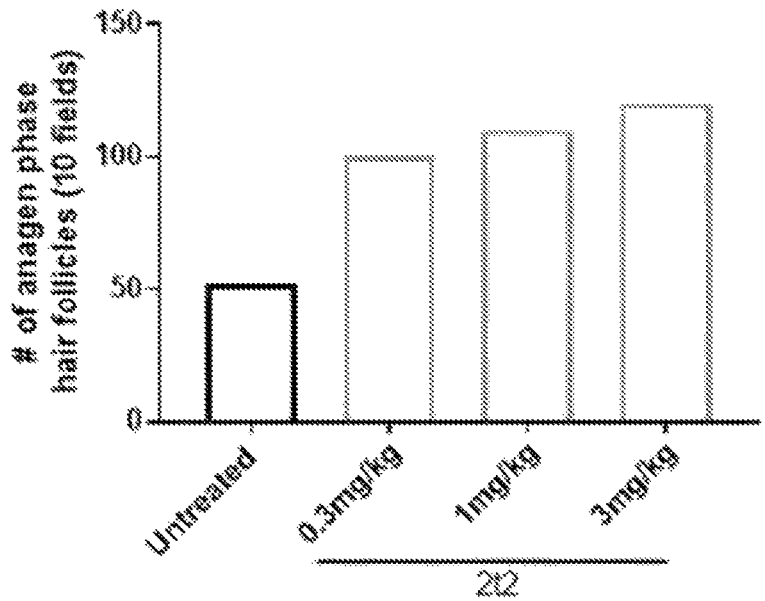

FIG. 193 shows the total number of anagen phase hair follicles counted per 10 fields for each treatment group.

Figure 194:
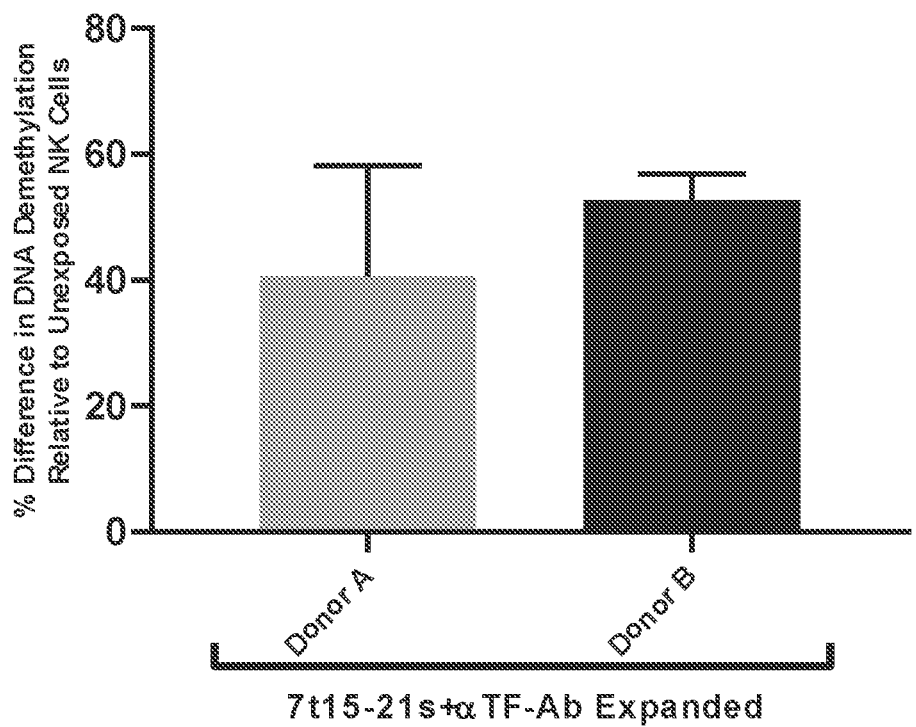

FIG. 194 is a graph showing the percentage different in DNA demethylation in NK cells (relative to unexposed NK cells) from two different donors following expansion with 7t15-21s+anti-tissue factor (TF)-antibody (IgG1) (50 nM).

Figure 195:
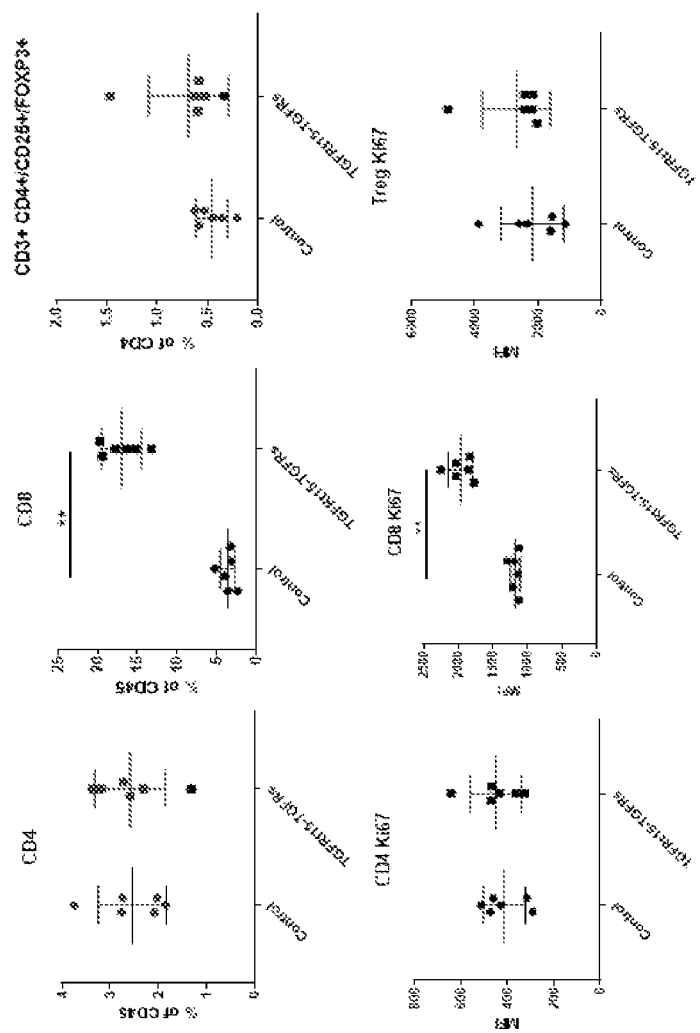

FIG. 195 is a set of graphs showing the immune-phenotype from peripheral blood analysis after 4 days post single dose treatment with TGFRt15-TGFRs.

Figure 196:
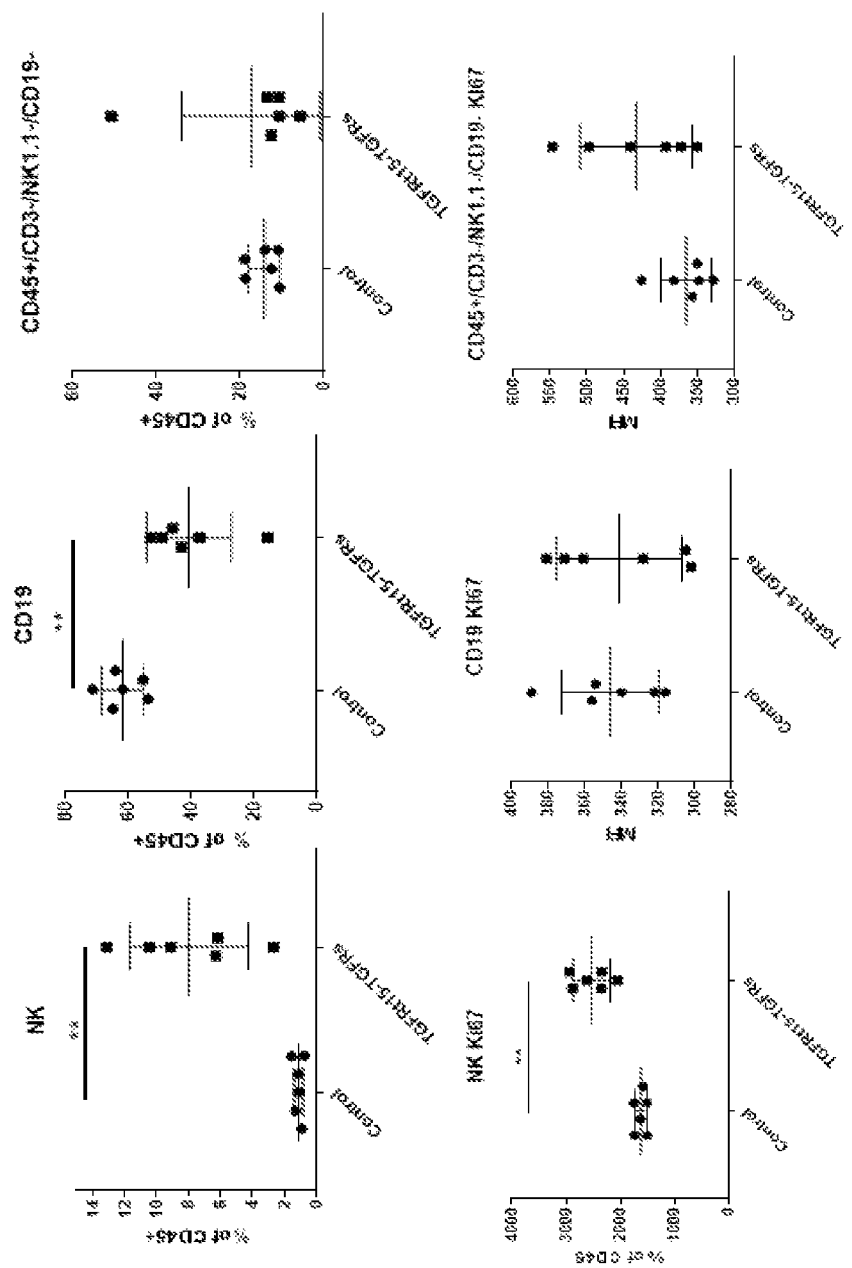

FIG. 196 is a set of graphs showing the immune-phenotype from peripheral blood analysis after 4 days post single dose treatment with TGFRt15-TGFRs.

Figure 197:
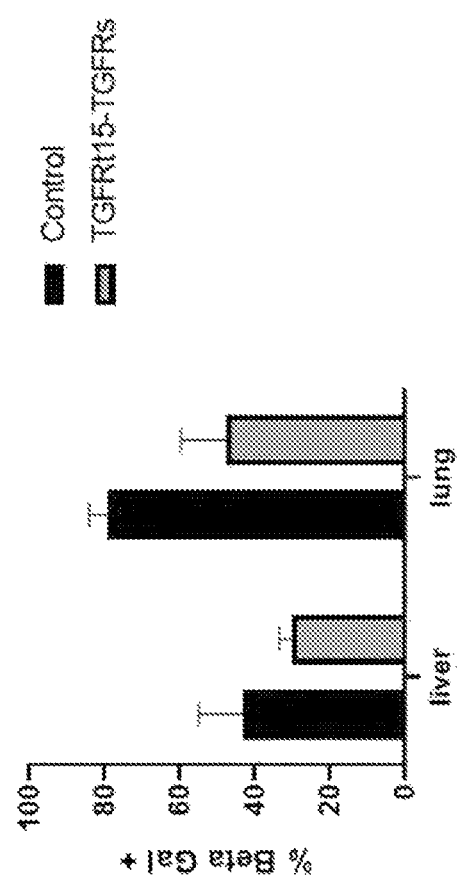

FIG. 197 is a graph showing 13-Gal staining analysis by FACS at seven days after the second administration with TGFRt15-TGFRs.

Figure 198:
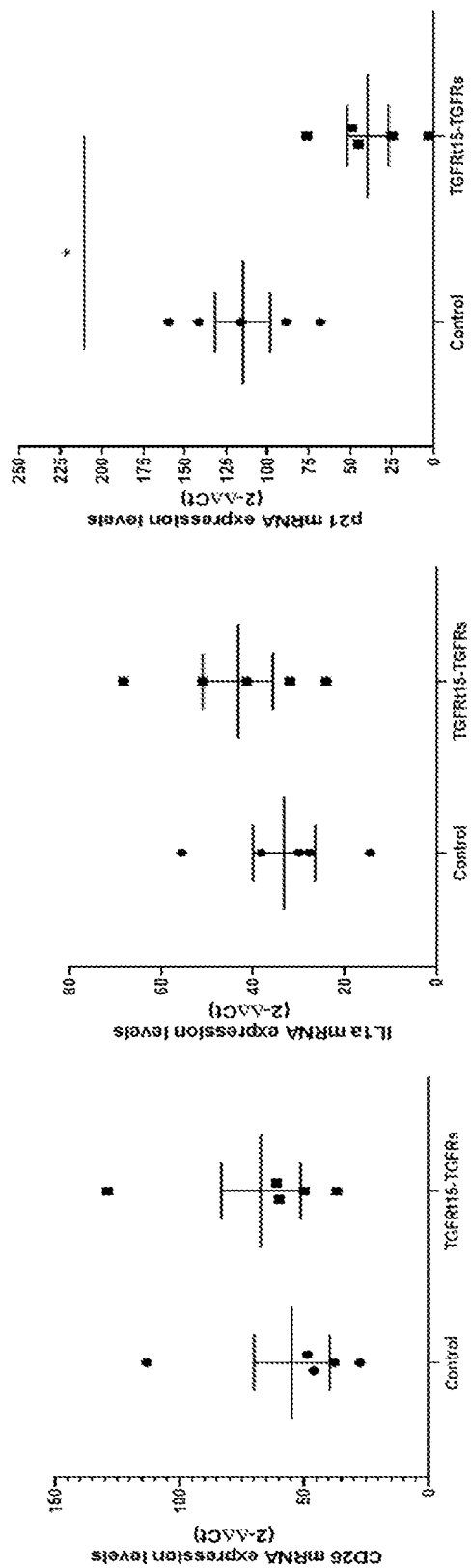

FIG. 198 is a set of graphs showing the levels of senescence markers in liver tissue determined using qPCR at 7 days after the second administration with TGFRt15-TGFRs.

Figure 199:
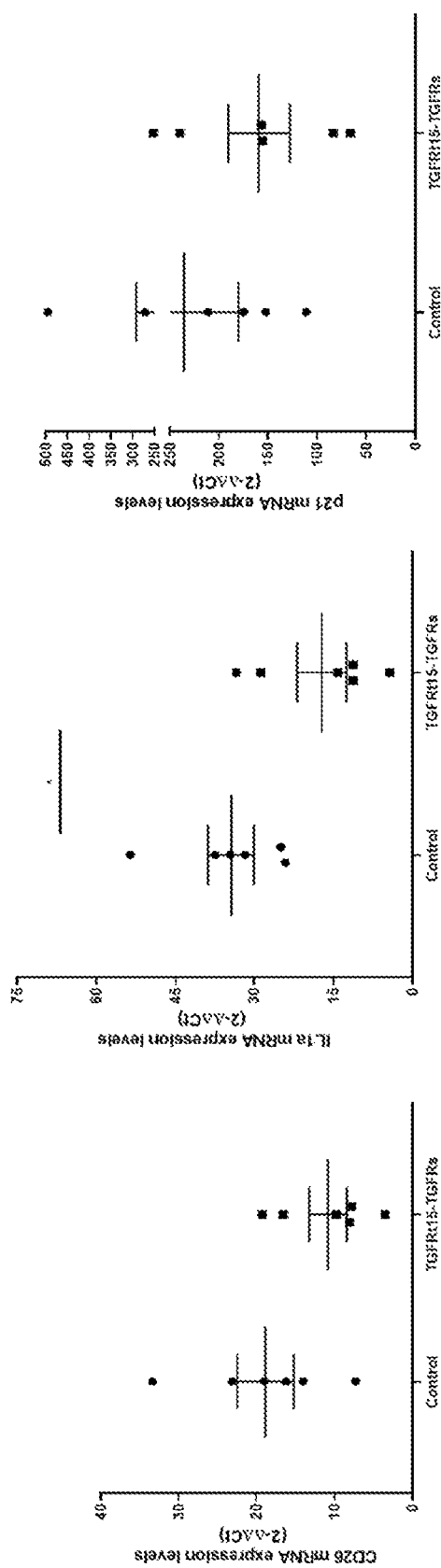

FIG. 199 is a set of graphs showing the levels of senescence markers in kidney tissue determined using qPCR at 7 days after the second administration with TGFRt15-TGFRs.

Figure 200:
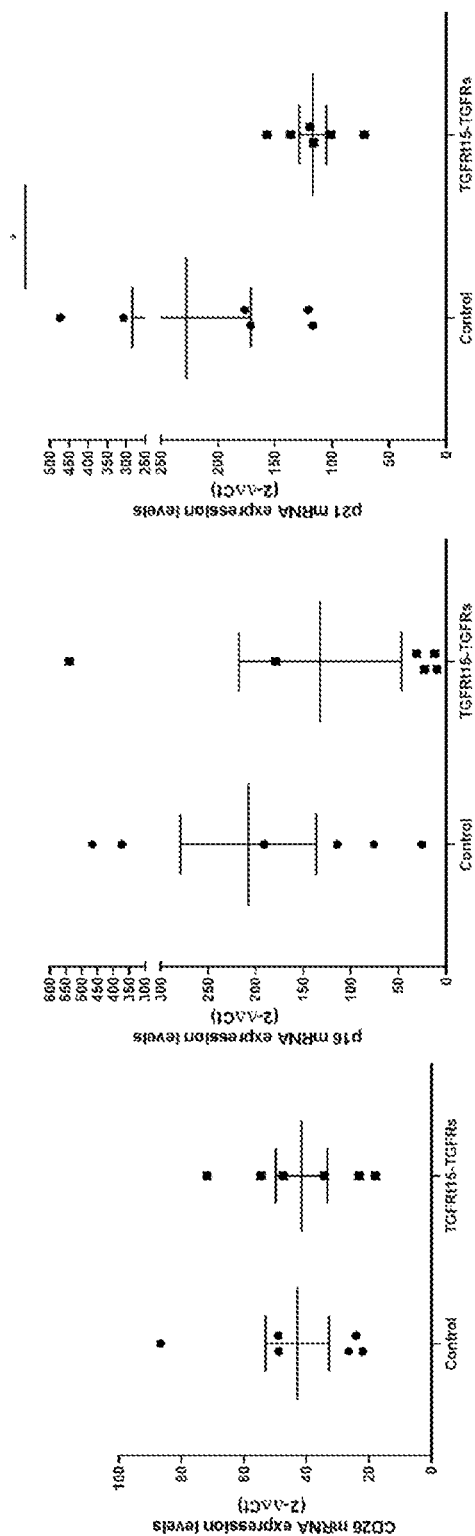

FIG. 200 is a set of graphs showing the levels of senescence markers in skin tissue determined using qPCR at 7 days after the second administration with TGFRt15-TGFRs.

Figure 201:
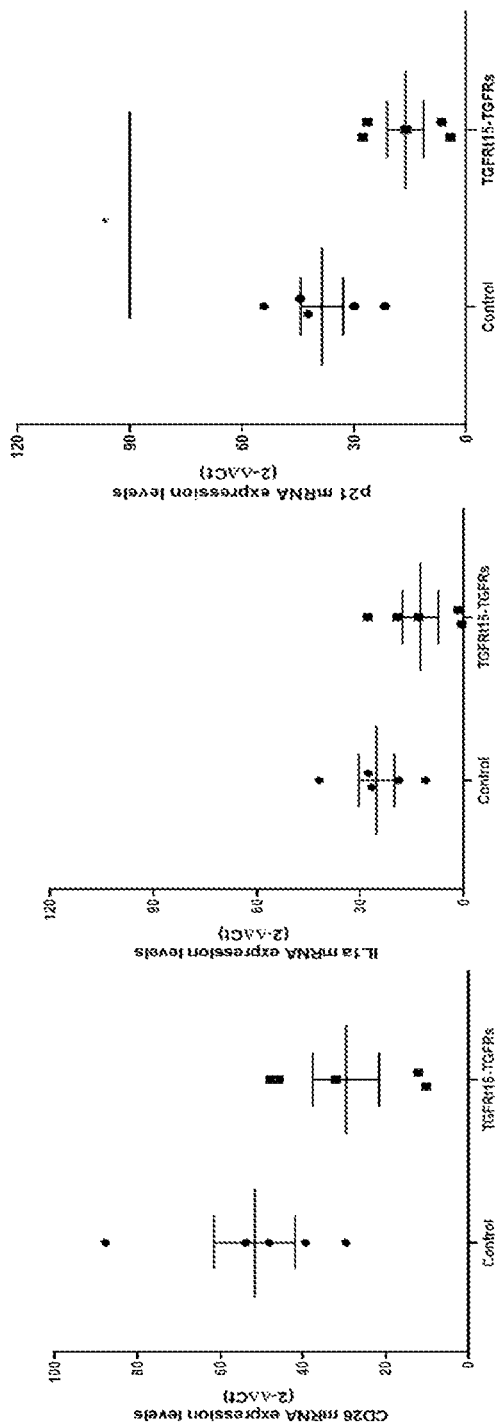

FIG. 201 is a set of graphs showing the levels of senescence markers in lung tissue determined using qPCR at 7 days after the second administration with TGFRt15-TGFRs.

Figure 202:
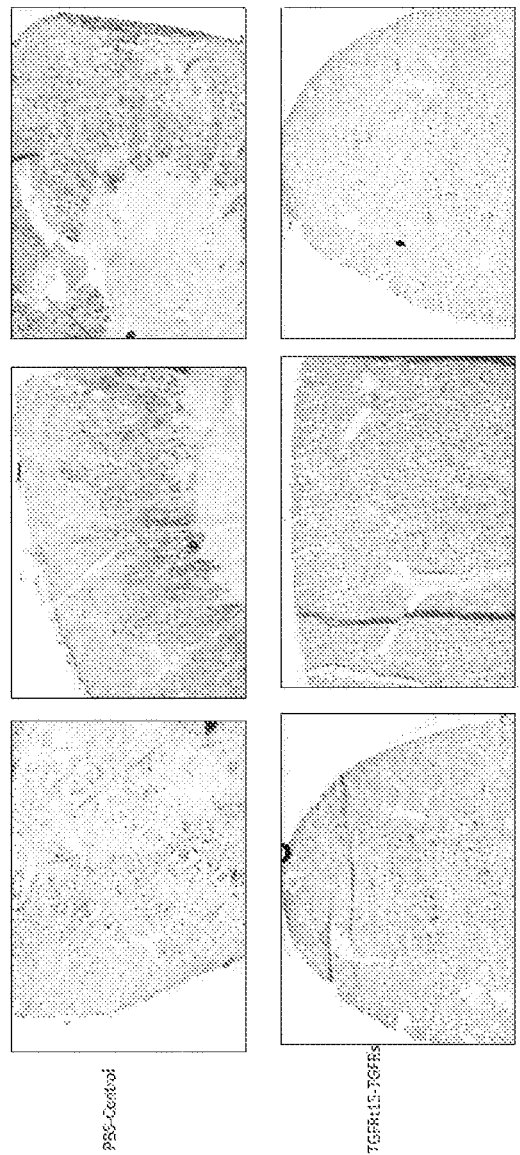

FIG. 202 is a set of histological images showing 13-Gal staining on kidney tissue at 7 days post second treatment with TGFRt15-TGFRs.

Figure 203:
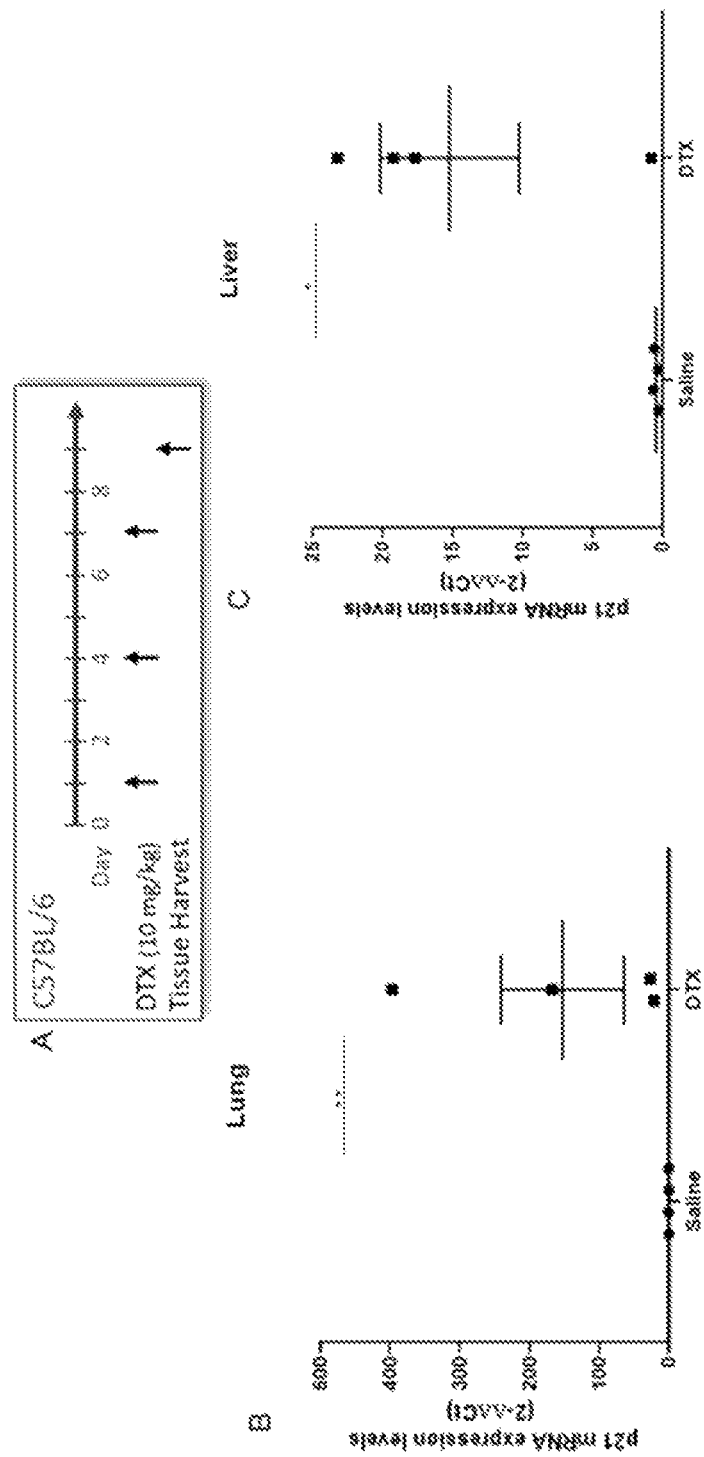

FIGS. 203A-203C show chemotherapy induces $p21^{CIP1}p21$ senescence-associated gene expression in C57BL/6 mice. FIG. 203A is an exemplary schematic showing the experimental treatment regimen. FIGS. 203B and 203C are graphs showing expression of $p21^{CIP1}p21$ in lung (B) and liver (C) tissues respectively.

Figure 204:
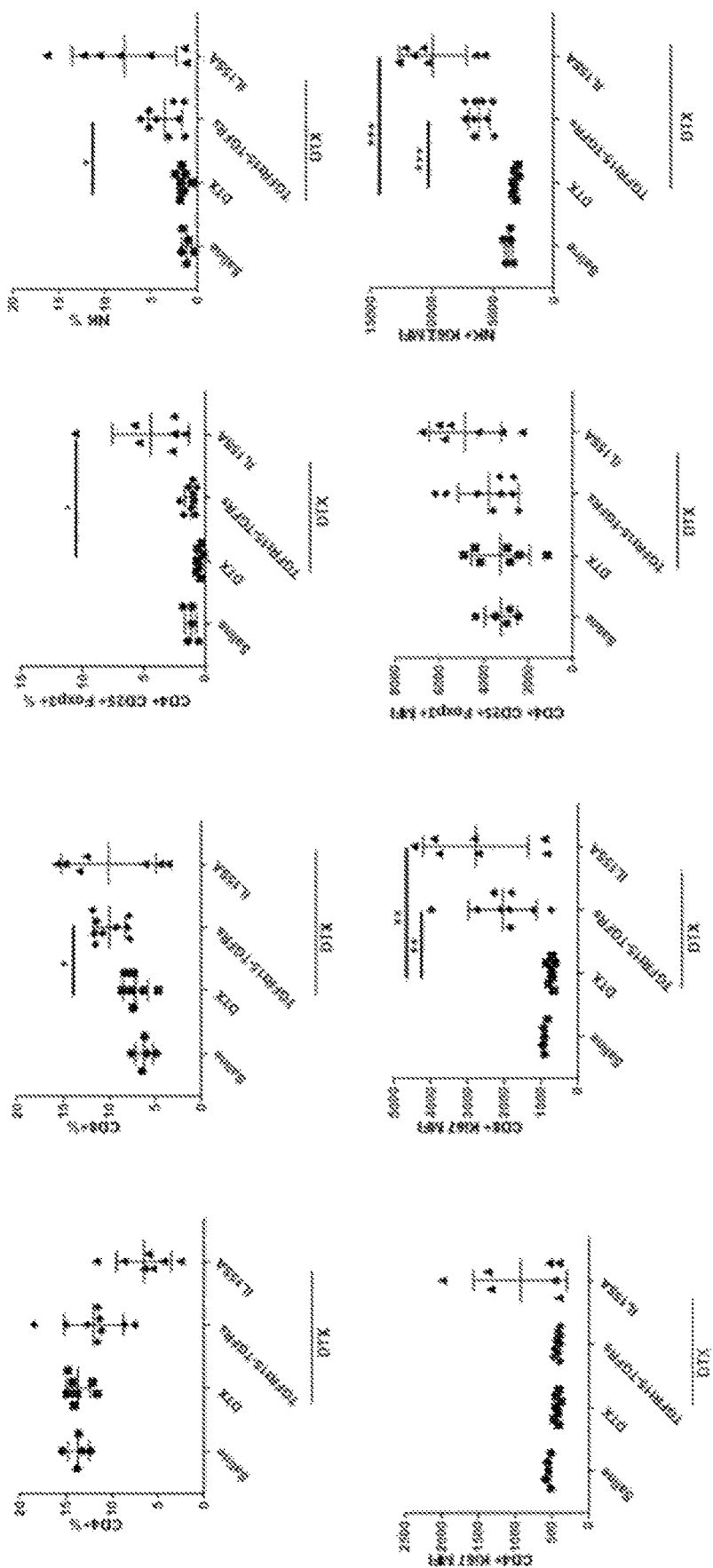

FIG. 204 is a set of graphs showing immune-phenotype and cell proliferation following treatment with IL-15-based agents at day 3 post treatment.

Figure 205:
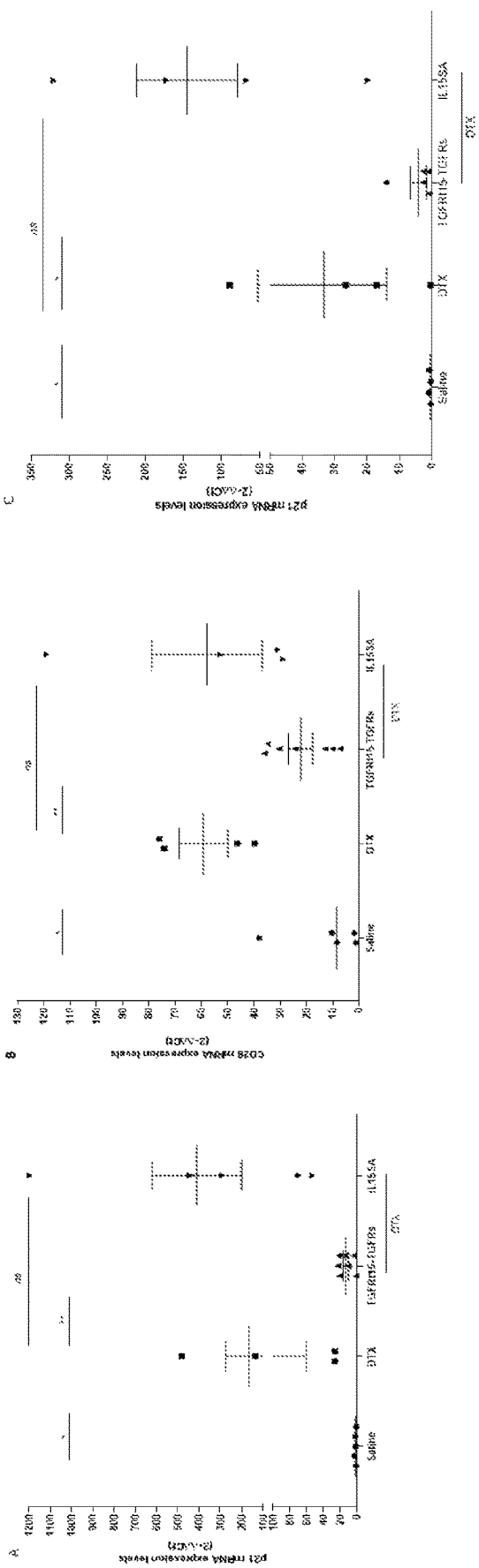

FIGS. 205A-205C are graphs showing TGFRt15-TGFRs treatment reduces senescence-associated gene expression in C57BL/6 mice. The graphs show expression of $p21^{CIP1}p21$ and CD26 in lung (A and B) and $p21^{CIP1}p21$ in liver (C) tissues respectively.

Figure 206:
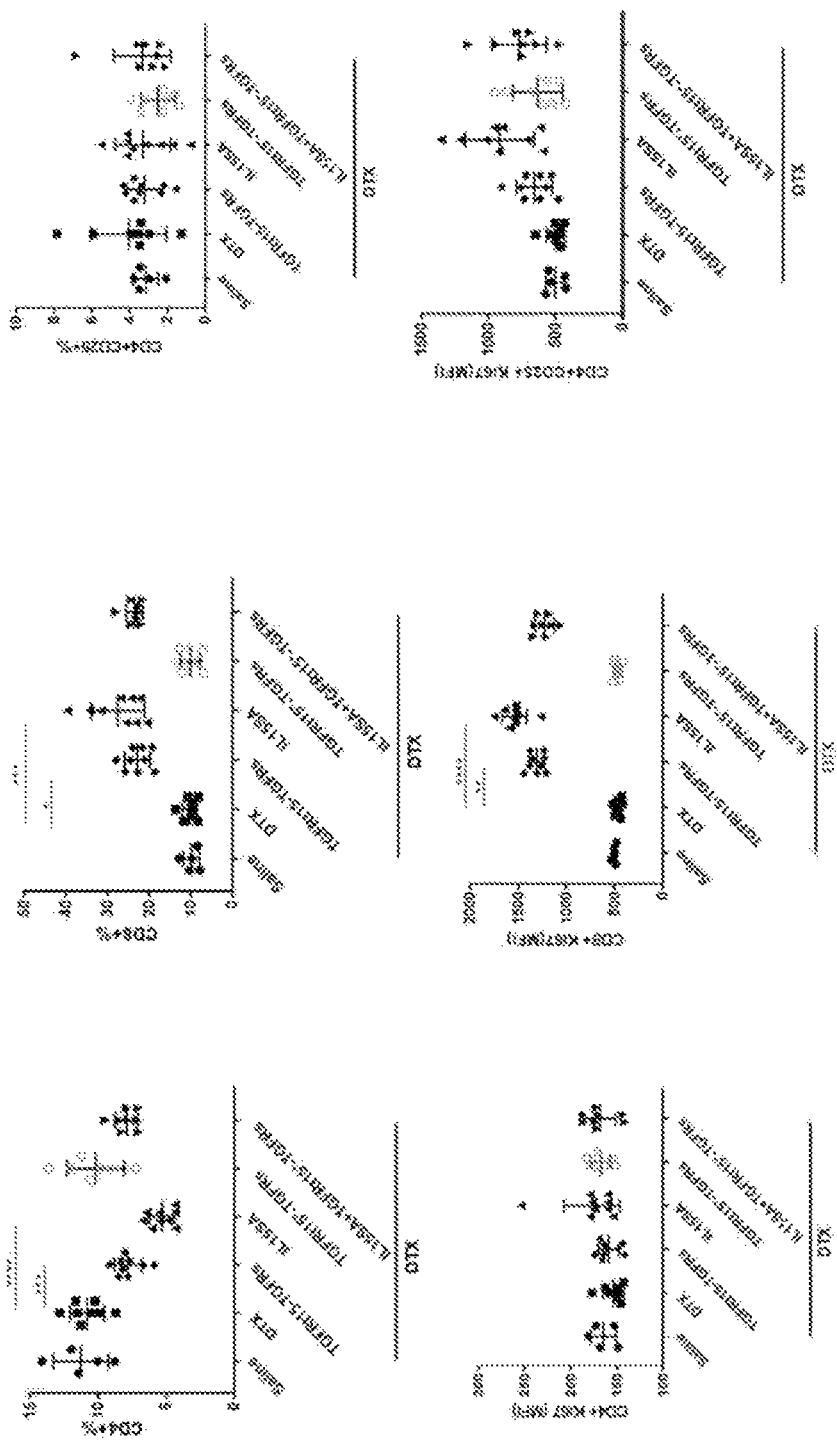

FIG. 206 is a set of graphs showing CD4+, CD8+, and Treg cell percentages and proliferation.

Figure 207:
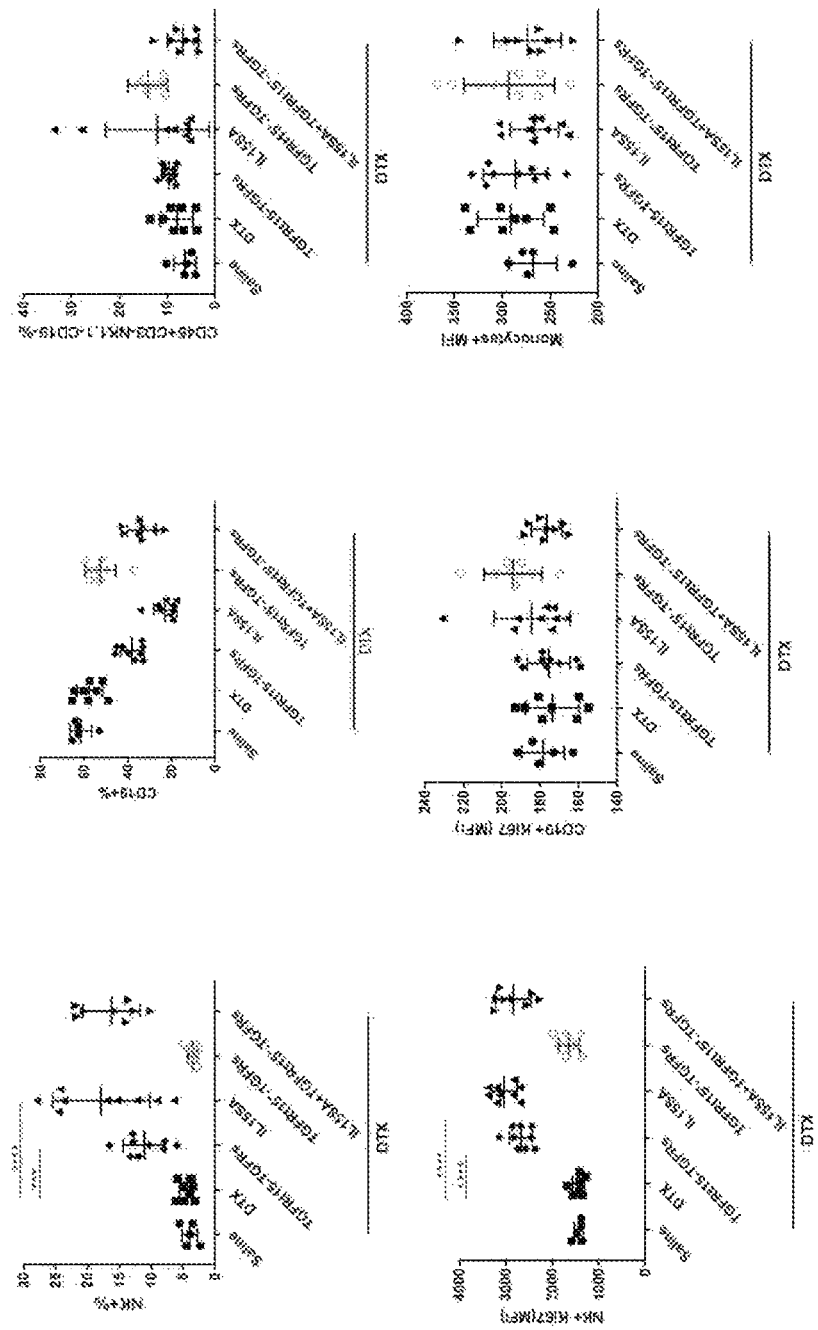

FIG. 207 is a set of graphs showing NK, $CD19^+$ and monocyte cell percentages and proliferation.

Figure 208:
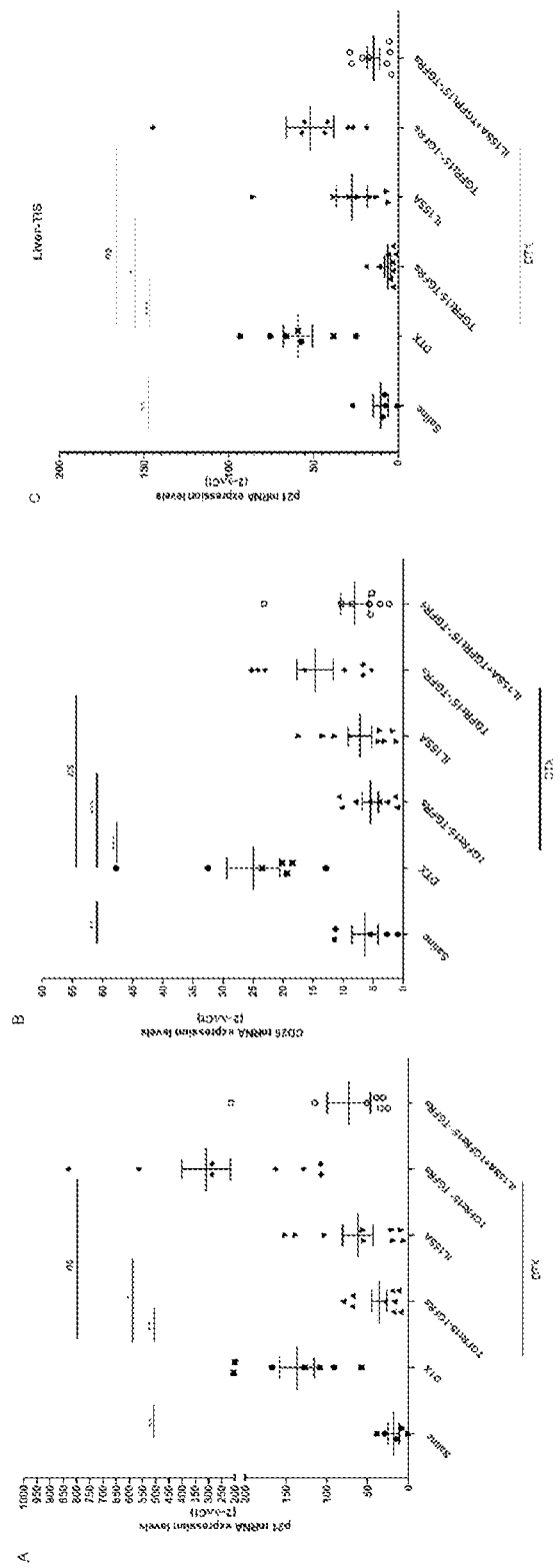

FIGS. 208A-208C are graphs showing evaluation of senescence markers $p21^{CIP1}p21$ and CD26 in lung and liver tissues. FIGS. 208A and 208B show lung $p21^{CIP1}p21$ (A) and lung CD26 (B) senescence markers. FIG. 208C shows liver $p21^{CIP1}p21$ senescence marker.

Figure 209:
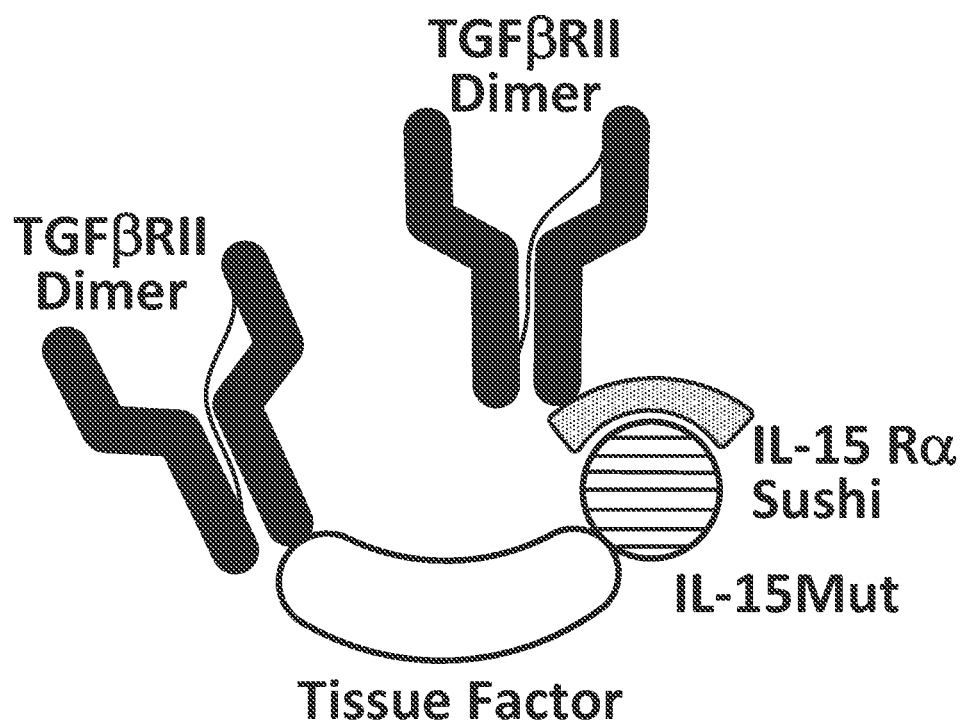

FIG. 209 shows a schematic diagram of the interaction between the exemplary TGFβRII/IL-15RαSu and TGFβRII/TF/IL-15Mut proteins resulting in TGFRt15*-TGFRs complex.

Figure 210:
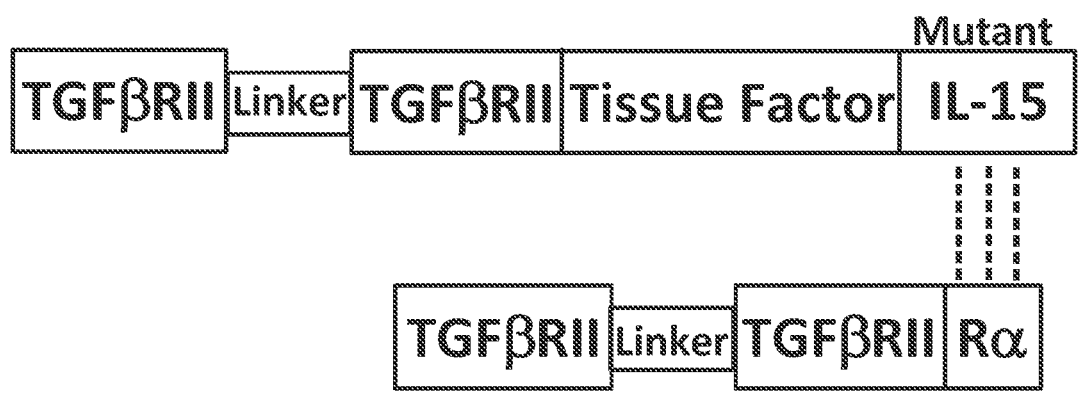

FIG. 210 shows a schematic diagram of the interaction between the exemplary TGFβRII/IL-15RαSu and TGFβRII/TF/IL-15Mut proteins.

Figure 211:
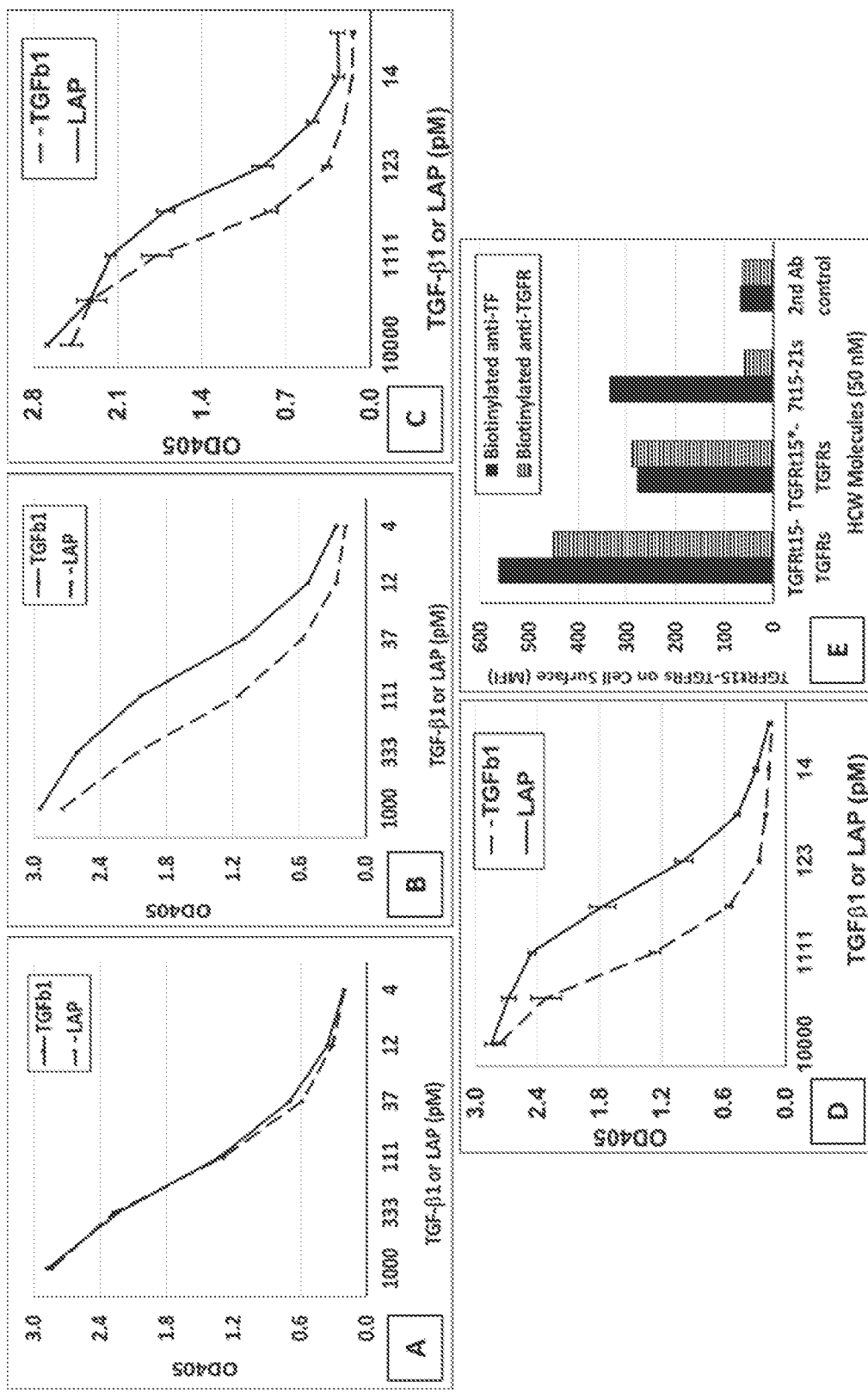

FIG. 211A is a graph showing the binding activity of TGFRt15-TGFRs to TGF-β1 and LAP.

FIG. 211B is a graph showing the binding activity of TGFRII/Fc to TGF-β1 and LAP.

FIG. 211C is a graph showing the binding activity of TGFRt15-TGFRs to TGF-β1 and LAP.

FIG. 211D is a graph showing the binding activity of TGFRt15*-TGFRs to TGF-β1 and LAP.

FIG. 211E is a graph showing the binding activity of TGFRt15-TGFRs, TGFRt15*-TGFRs, and 7t15-21s to CTLL-2 cells.

Figure 212:
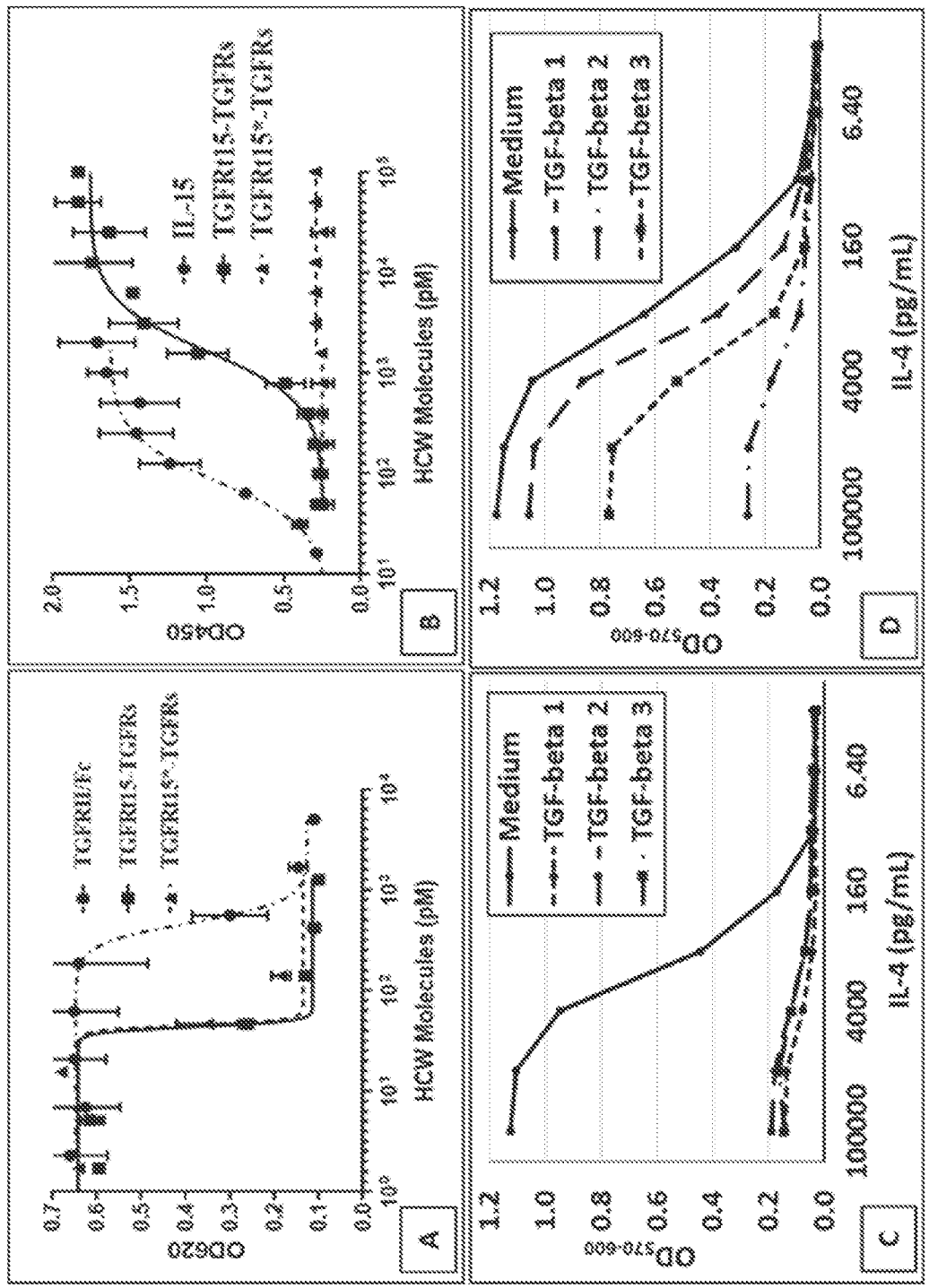

FIG. 212A is a graph of TGF-β1 blocking activity of TGFRt15-TGFRs and TGFRt15*-TGFRs.

FIG. 212B is a graph of the IL-15 biological activity of TGFRt15-TGFRs and TGFRt15*-TGFRs.

FIG. 212C is a graph showing that TGF-β1, TGF-β2, and TGF-β3 each similarly inhibit IL-4-induced CTLL-2 growth in the absence of TGFRt15*-TGFRs.

FIG. 212D is a graph showing that TGFRt15*-TGFRs significantly reversed the inhibition of TGF-β1 and TGF-03 of IL-4-induced CTLL-2 cell growth.

Figure 213:
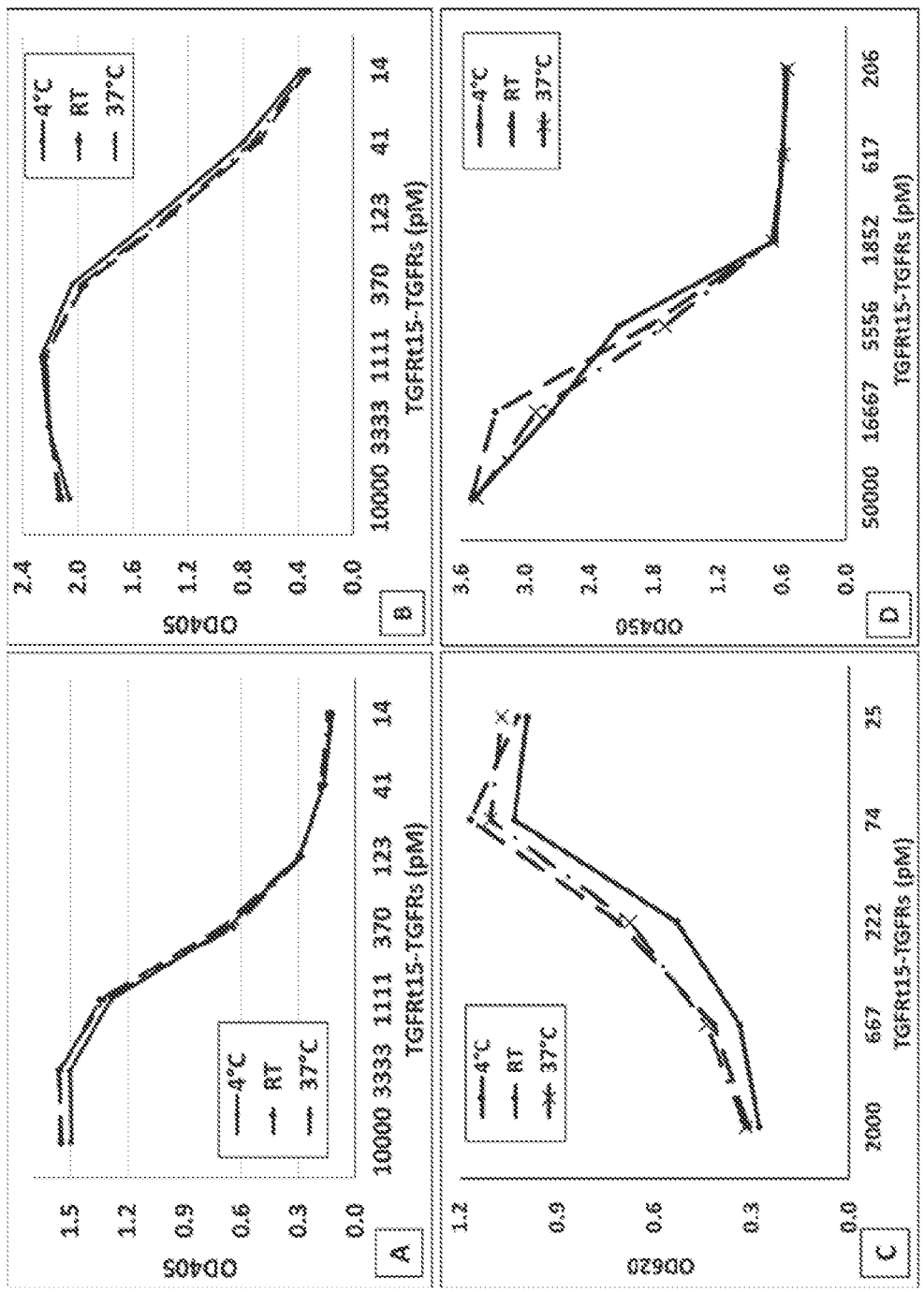

FIG. 213A shows that there is no significant damage to the IL-15 domain of TGFRt15-TGFRs following 10-day incubation 4° C., 25° C., or 37° C.

FIG. 213B shows that there is no significant damage to the TGFβ-RII domain of TGFRt15-TGFRs following 10-day incubation 4° C., 25° C., or 37° C.

FIG. 213C is a graph showing TGF-β1 neutralizing activity of TGFRt15-TGFRs following incubation in human serum for 10 days at 4° C., 25° C., or 37° C.

FIG. 213D is a graph showing IL-15 activity of TGFRt15-TGFRs following incubation in human serum for 10 days at 4° C., 25° C., or 37° C.

Figure 214:
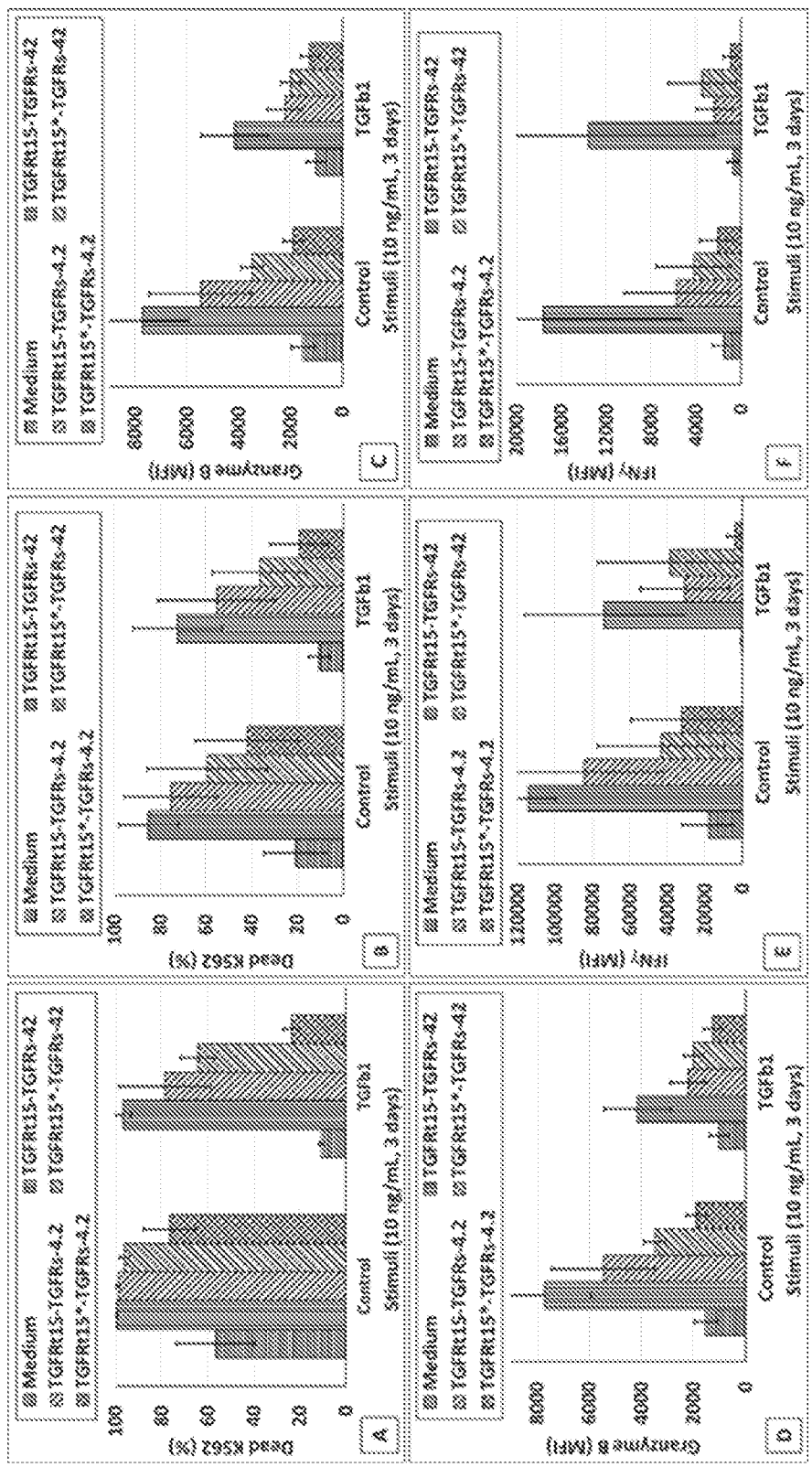

FIG. 214A is a graph showing cell-mediated cell cytotoxicity in an assay using NK cells and the constructs shown.

FIG. 214B is a graph showing cell-mediated cell cytotoxicity in an assay using PMBCs and the constructs shown.

FIG. 214C is a graph showing intracellular granzyme B production in an assay using NK cells and the constructs shown.

FIG. 214D is a graph showing intracellular granzyme B production in an assay using PBMCs and the constructs shown.

FIG. 214E is a graph showing interferon-gamma production in an assay using NK cells and the constructs shown.

FIG. 214F is a graph showing interferon-gamma production in an assay using PMBCs and the constructs shown.

Figure 215:
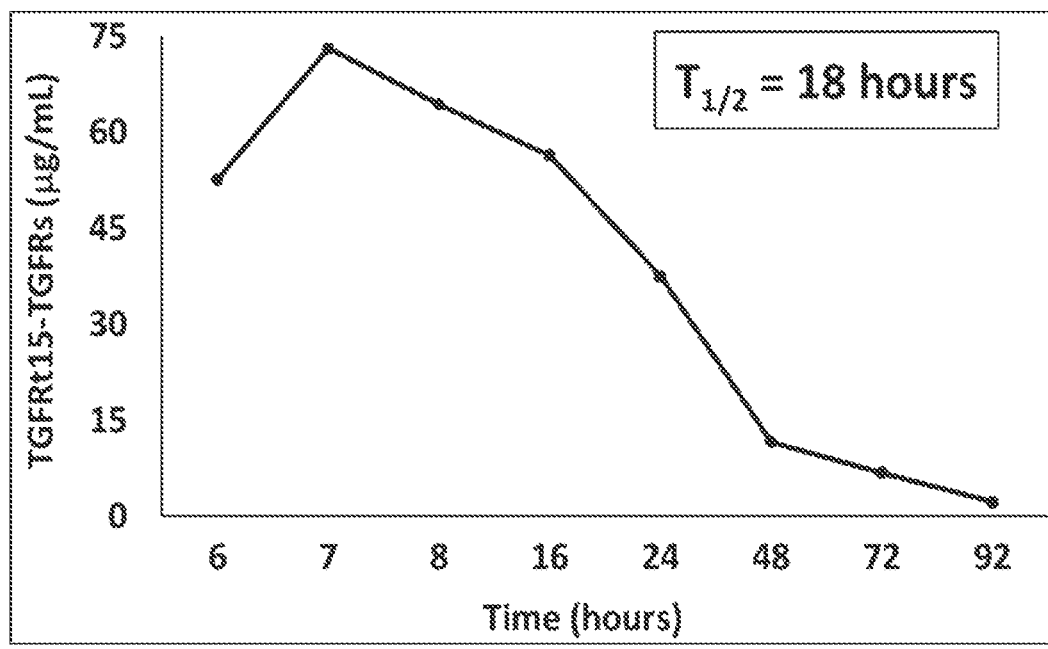

FIG. 215 is a graph showing the pharmacokinetics (half-life, $t_{1/2}$) of TGFRt15-TGFRs evaluated in female C57BL/6 mice.

Figure 216:
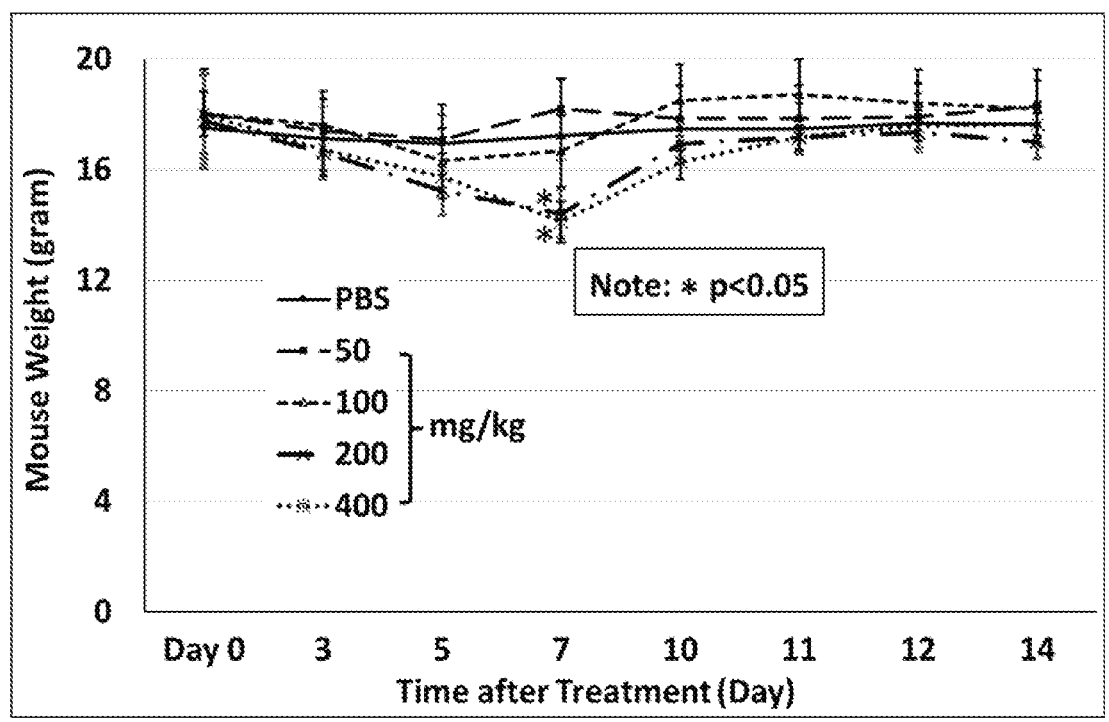

FIG. 216 is a graph showing toxicity of TGFRt15-TGFRs in C57BL/6 mice.

Figure 217:
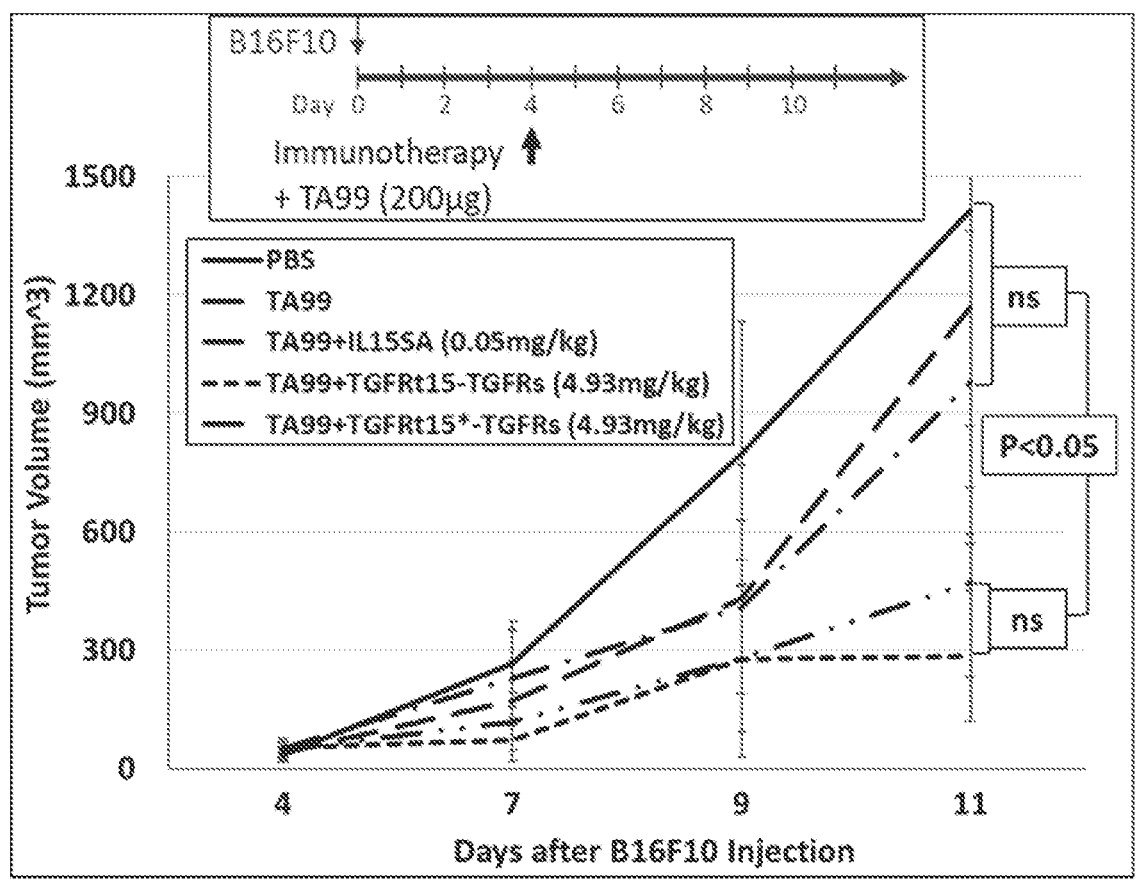

FIG. 217 is a graph showing antitumor activity of TGFRt15-TGFRs in a C57BL/6 murine melanoma model.

Figure 218:
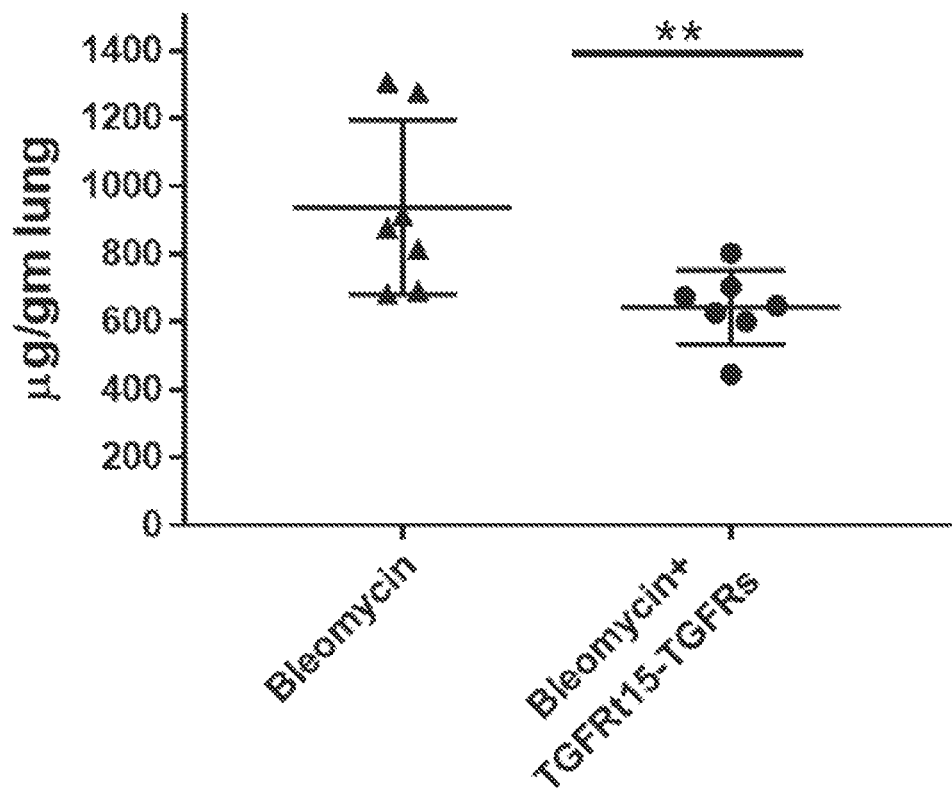

FIG. 218 shows activity of TGFRt15-TGFRs in nine-week old C57BL6/j male mice, wherein the mice were given 50 µl of bleomycin (2.5 mg/kg, single dose) through the oropharyngeal route and then were given TGFRt15-TGFRs subcutaneously (3 mg/kg) on day 17 following bleomycin treatment.

Figure 219:
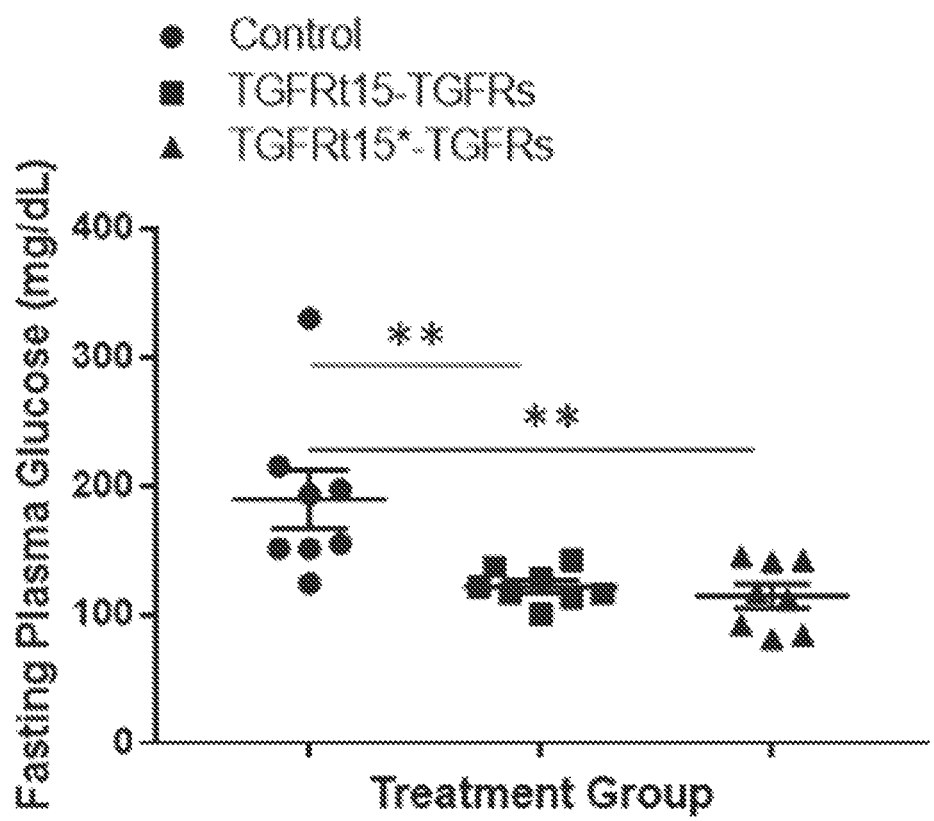

FIG. 219 shows fasting plasma glucose levels in db/db mice 4 days post treatment with TGFRt15-TGFRs or TGFRt15*-TGFRs.

Figure 220A:
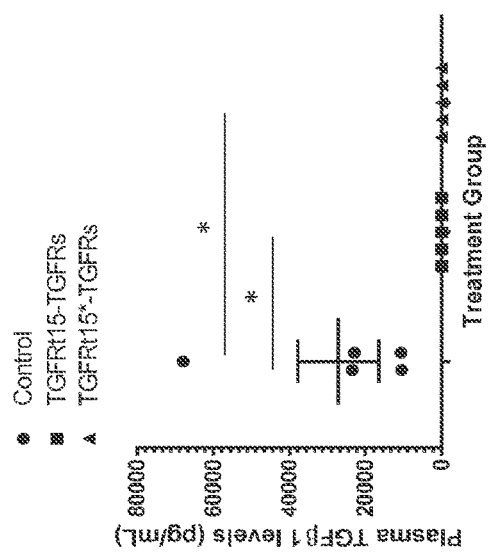
Figure 220C:
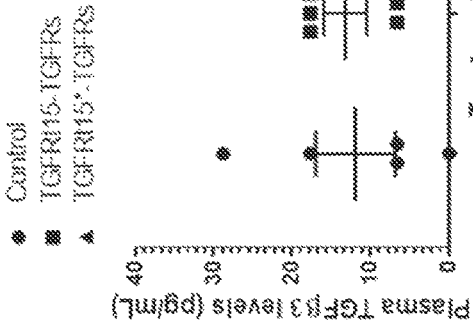
Figure 220B:
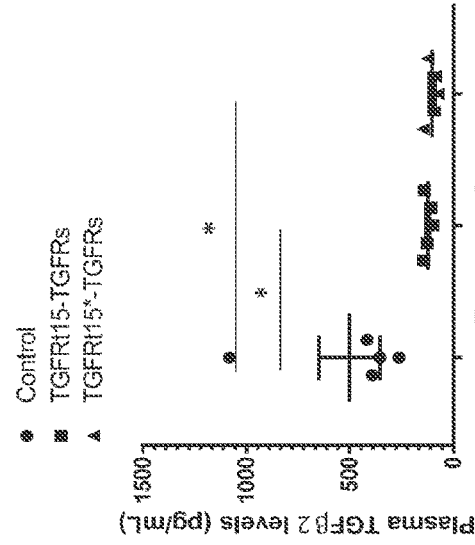

FIGS. 220A-220C show TGFβ1-3 levels in db/db mice 4 days post treatment with TGFRt15-TGFRs or TGFRt15*-TGFRs: TGFβ1 (FIG. 220A), TGFβ2 (FIG. 220B), and TGFβ3 (FIG. 220C).

FIGS. 221A-E show lymphocyte subsets in db/db mice 4 days post treatment with TGFRt15-TGFRs or TGFRt15*-TGFRs: blood NK cells (FIG. 221A), blood Ki67+ NK cells (FIG. 221B), blood granzyme (GzmIr) (FIG. 221C), blood CD8+ (FIG. 221D), and blood CD8+Ki67+ T cells (FIG. 221E).

Figure 222A:
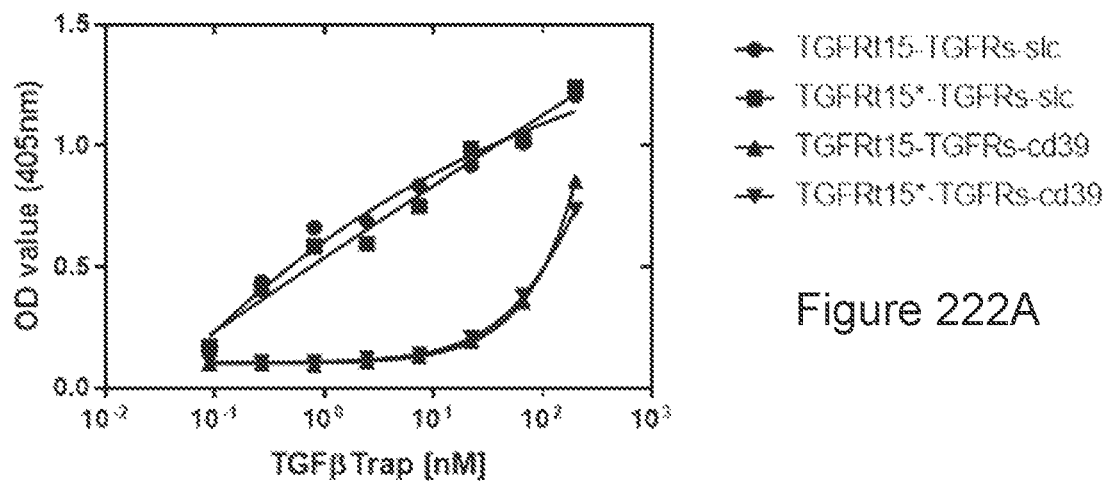

FIG. 222A shows the interaction of TGFRt15*-TGFRs or TGFRt15-TGFRs with latent TGFβ1 (SLC) or with CD39 (control).

Figure 222B:
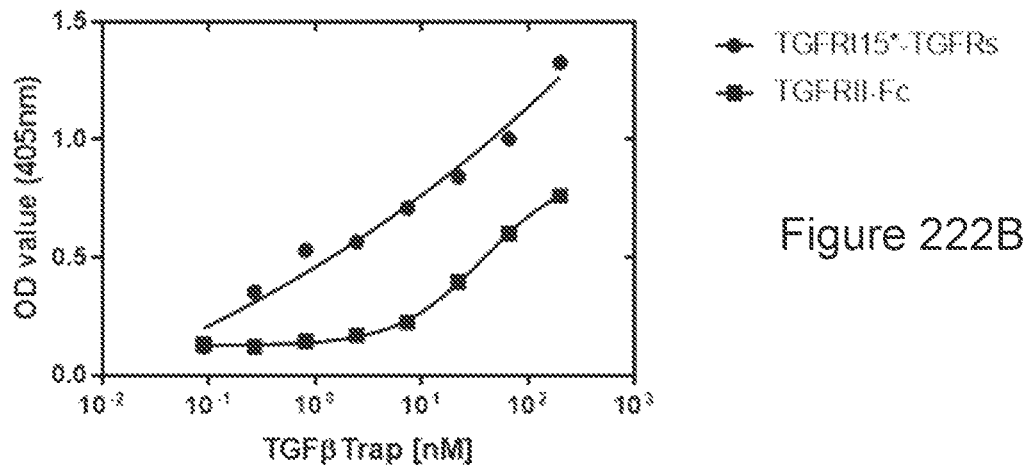
Figure 233:
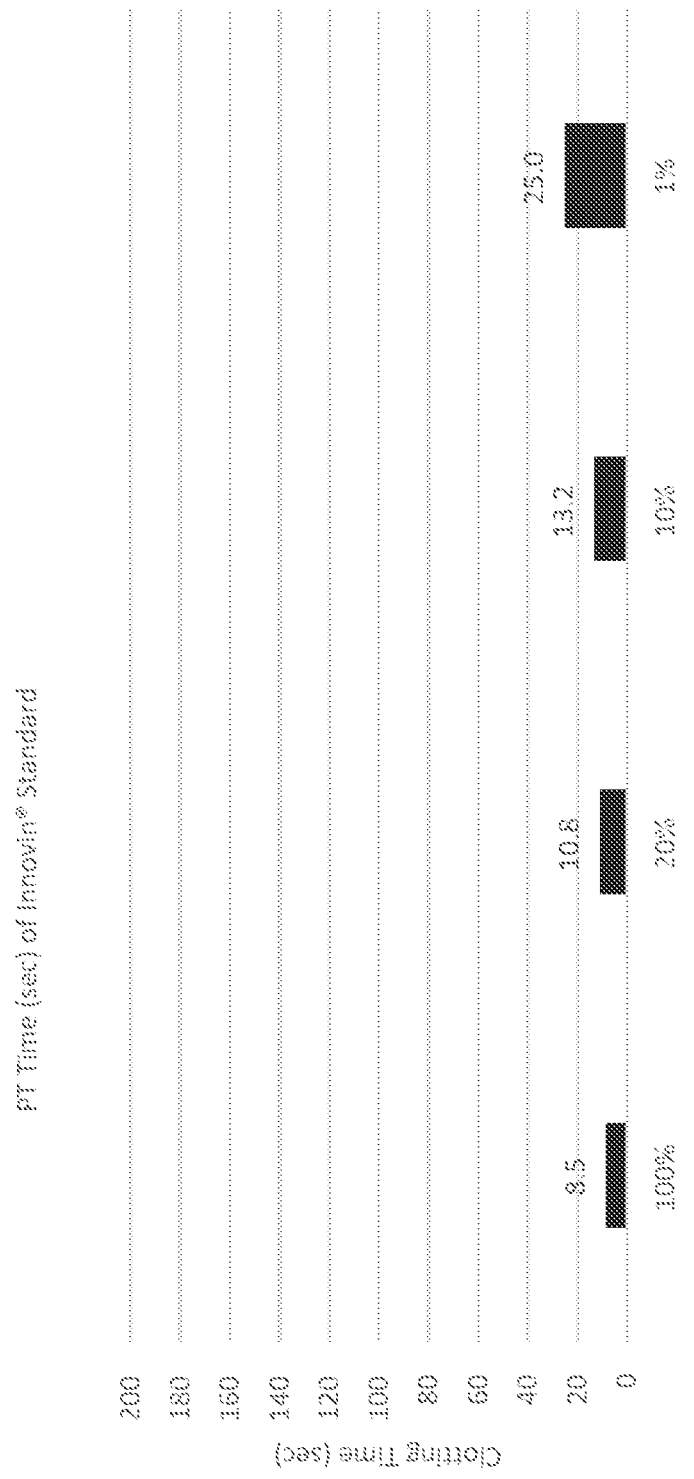

FIG. 222B shows the interaction of TGFRt15*-TGFRs and TGFRII-Fc with latent TGFβ1.

FIG. 223 is a graph showing the clotting time of Innovin in the PT assay.

Figure 224:
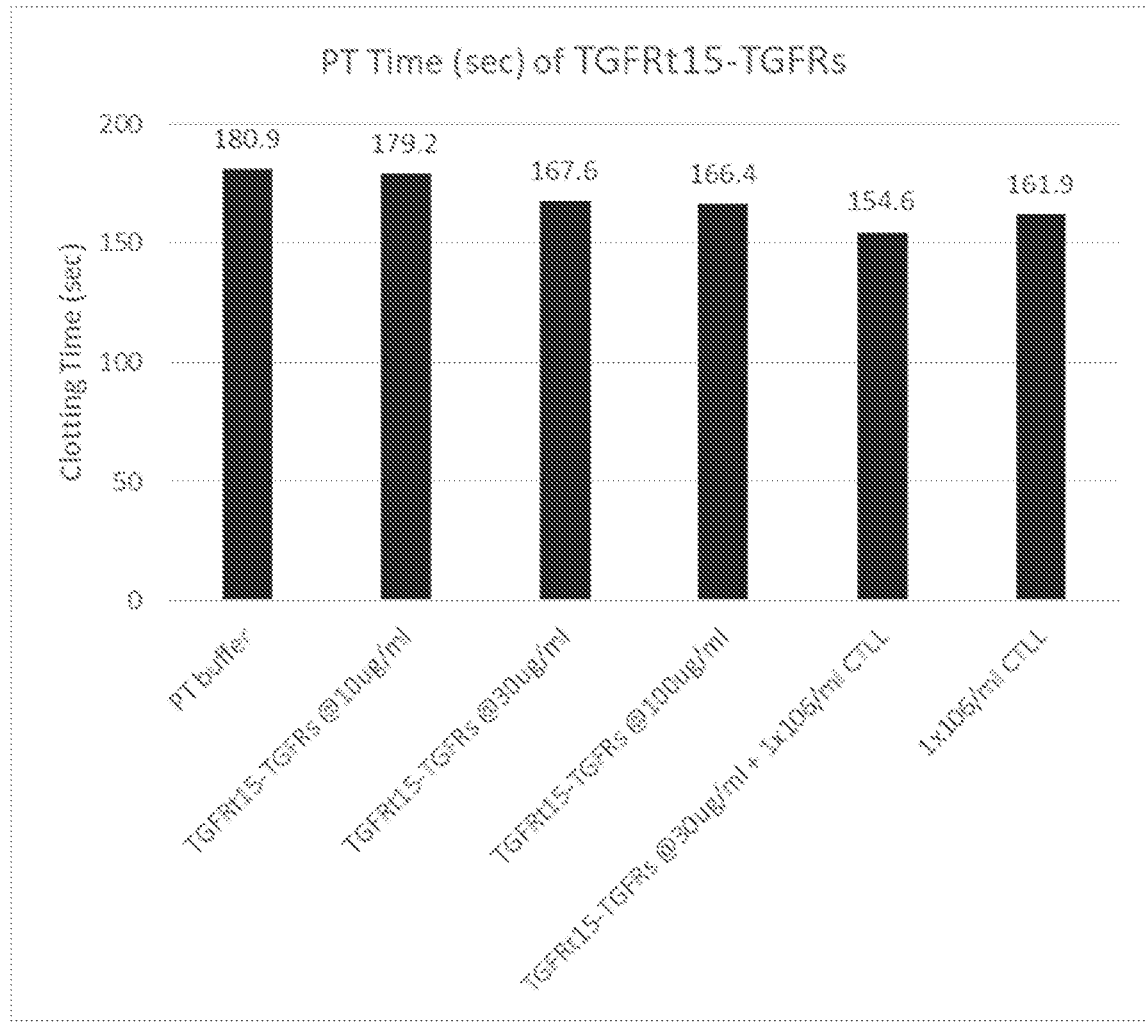

FIG. 224 is a graph showing the clotting time of TGFRt15-TGFRs in the PT assay.

Figure 225:
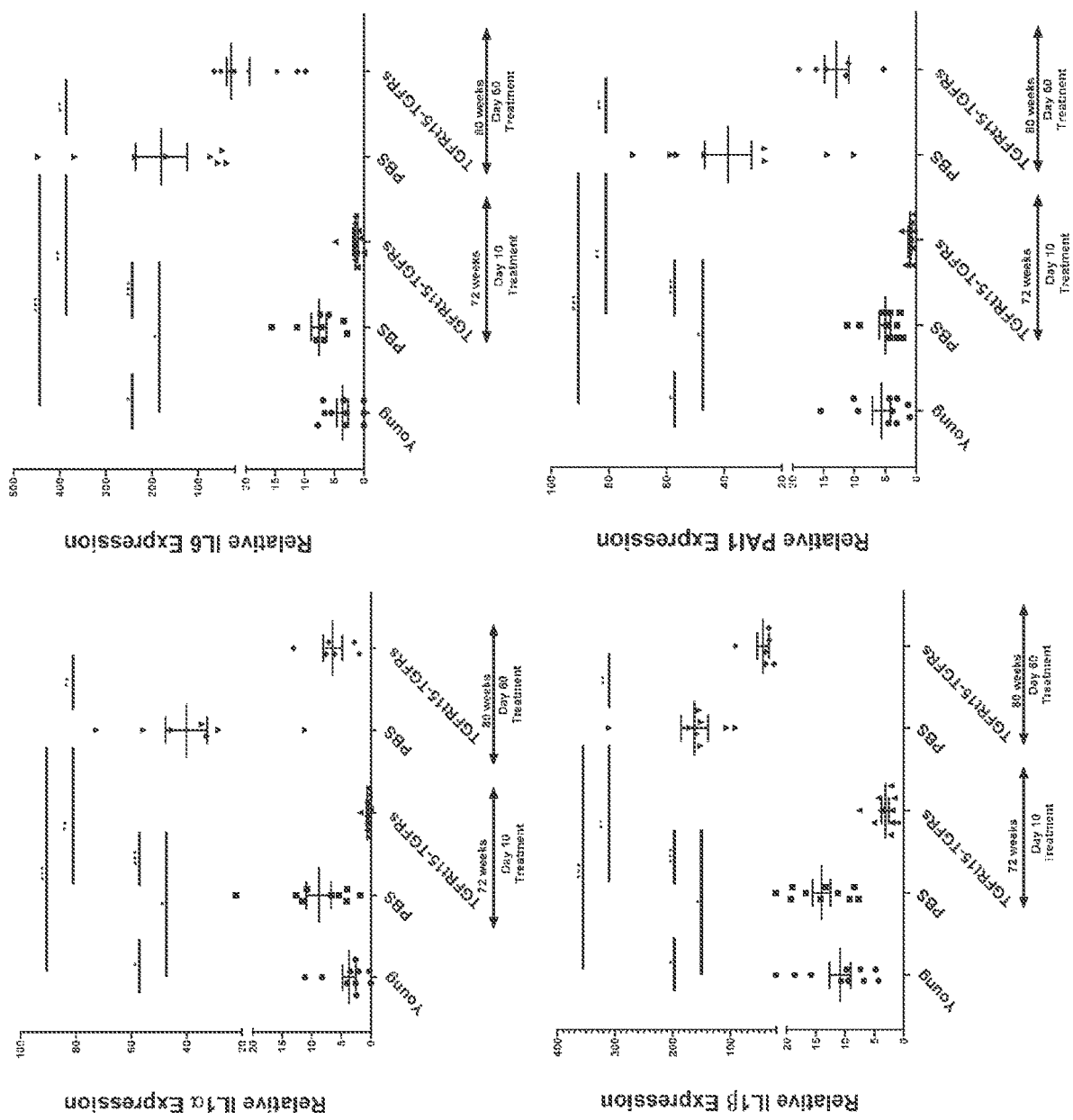

FIG. 225 are graphs showing gene expression of senescence markers PAI-1, IL-1α, IL6, and IL-1β in kidney and comparing young vs PBS or TGFRt15-TGFRs treated aged mice with short term vs long term follow-up.

Figure 226:
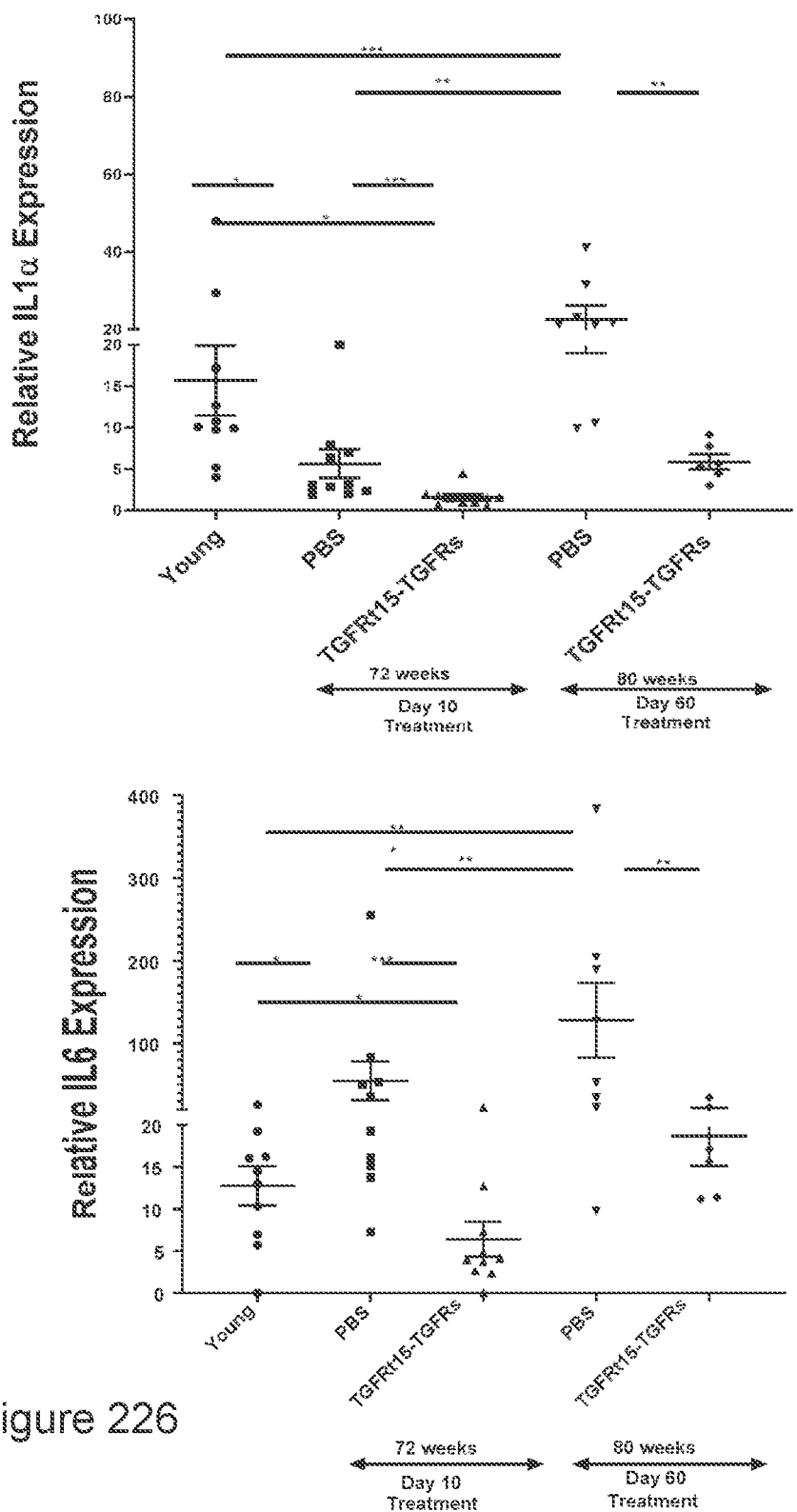

FIG. 226 are graphs showing gene expression of senescence markers IL-1α and IL6 in liver.

Figure 227:
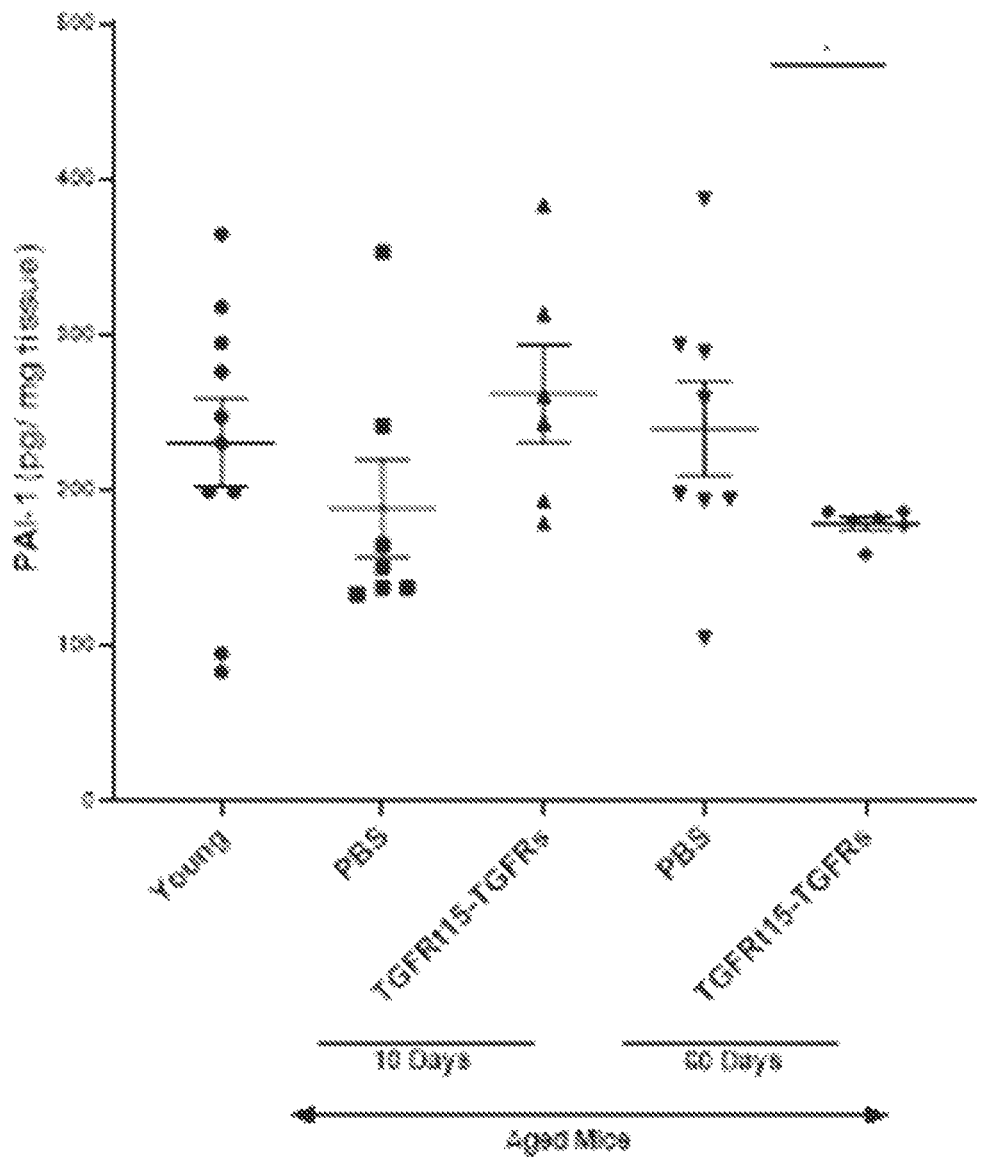

FIG. 227 shows protein expression of senescence marker PAI-1 in kidney.

Figure 228:
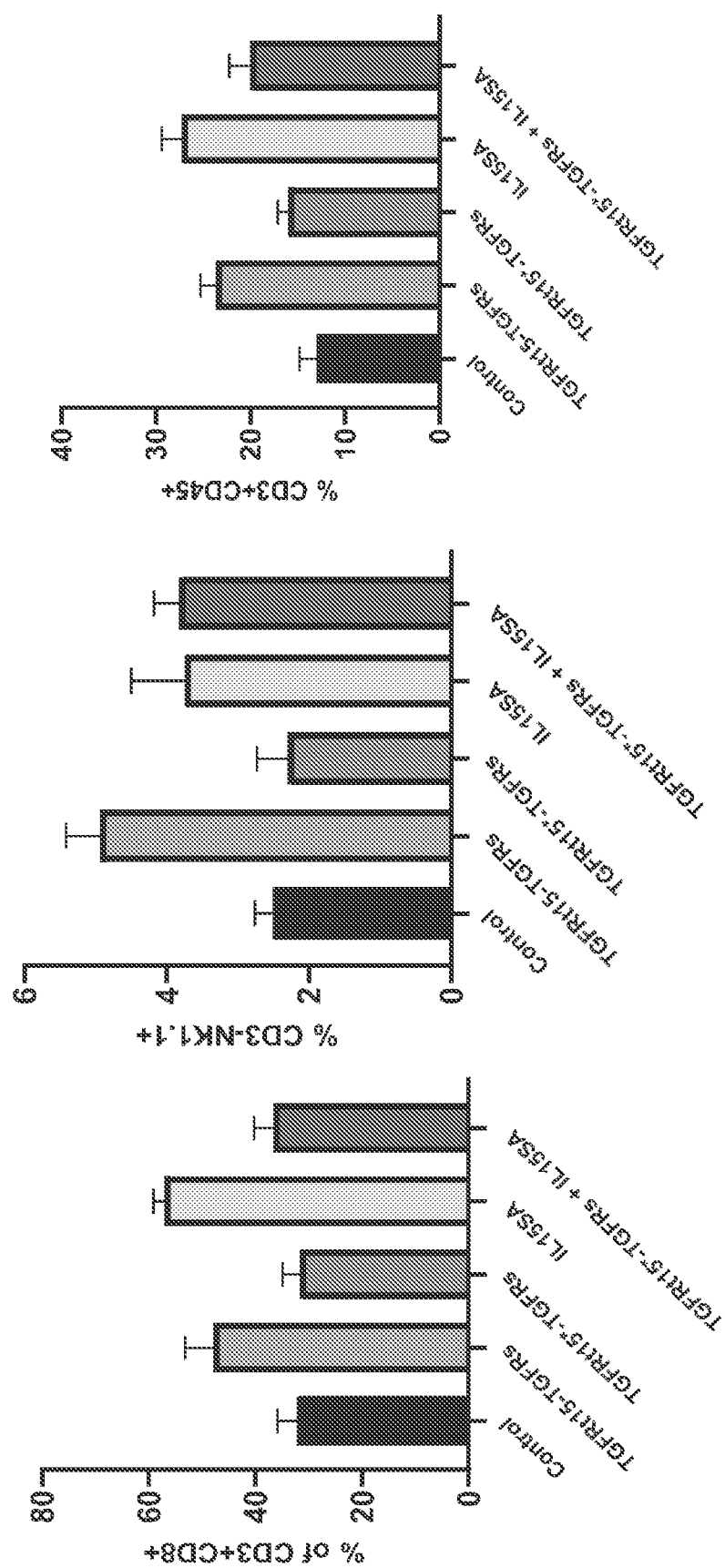

FIG. 228 are graphs showing that IL15SA (positive control) or TGFRt15*-TGFRs+IL15SA mediated an increase in the percentages of CD3+CD8+, CD3−NK1.1+, and CD3+CD45+ immune cells in the blood, whereas treatment with TGFRt15*-TGFRs had little or no effect on the percentage of these cell populations.

Figure 229:
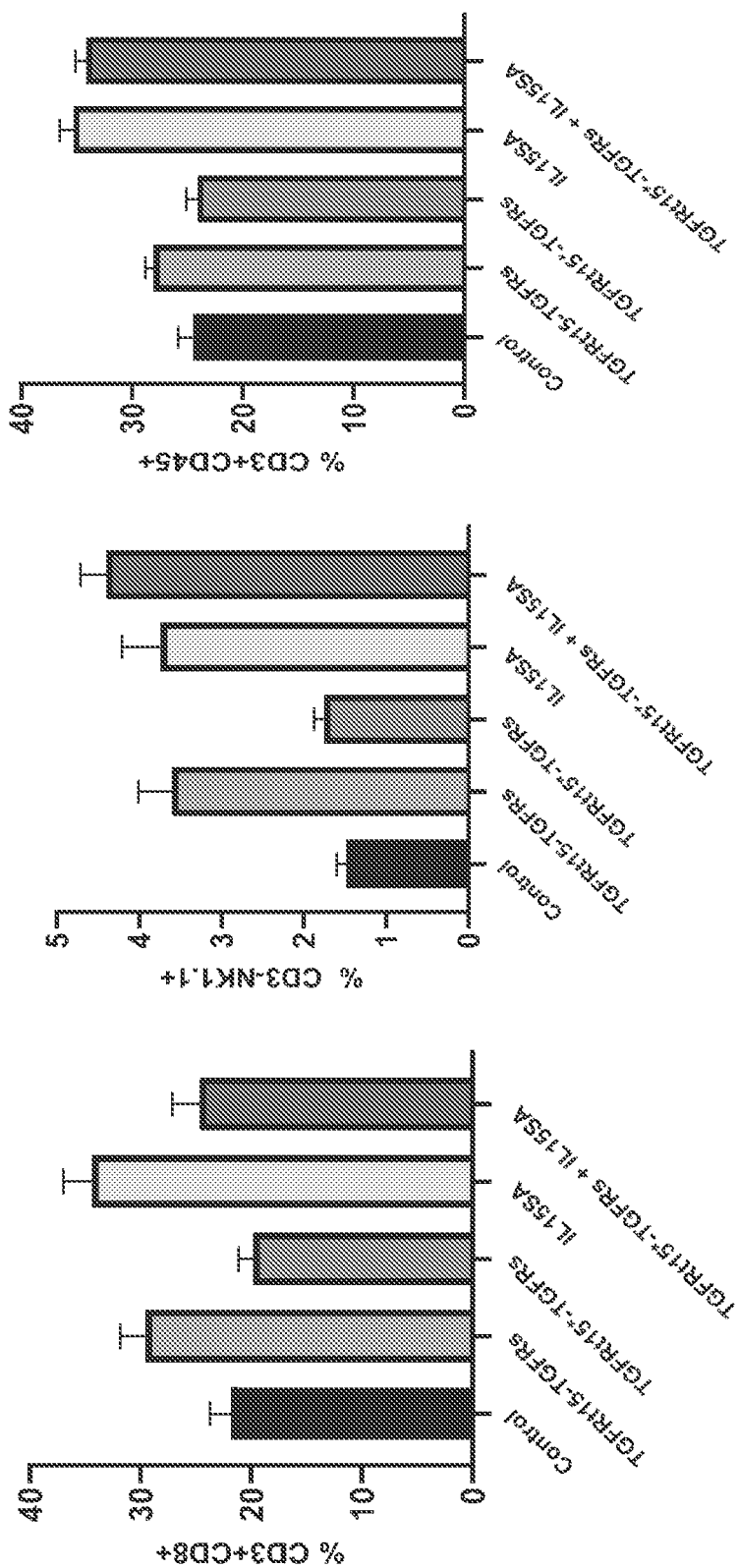

FIG. 229 are graphs showing that IL15SA (positive control) or TGFRt15*-TGFRs+IL15SA mediated an increase in the percentages of CD3+CD8+, CD3−NK1.1+, and CD3+CD45+ immune cells in the spleen, whereas treatment with TGFRt15*-TGFRs had little or no effect on the percentage of these cell populations.

Figure 230A:
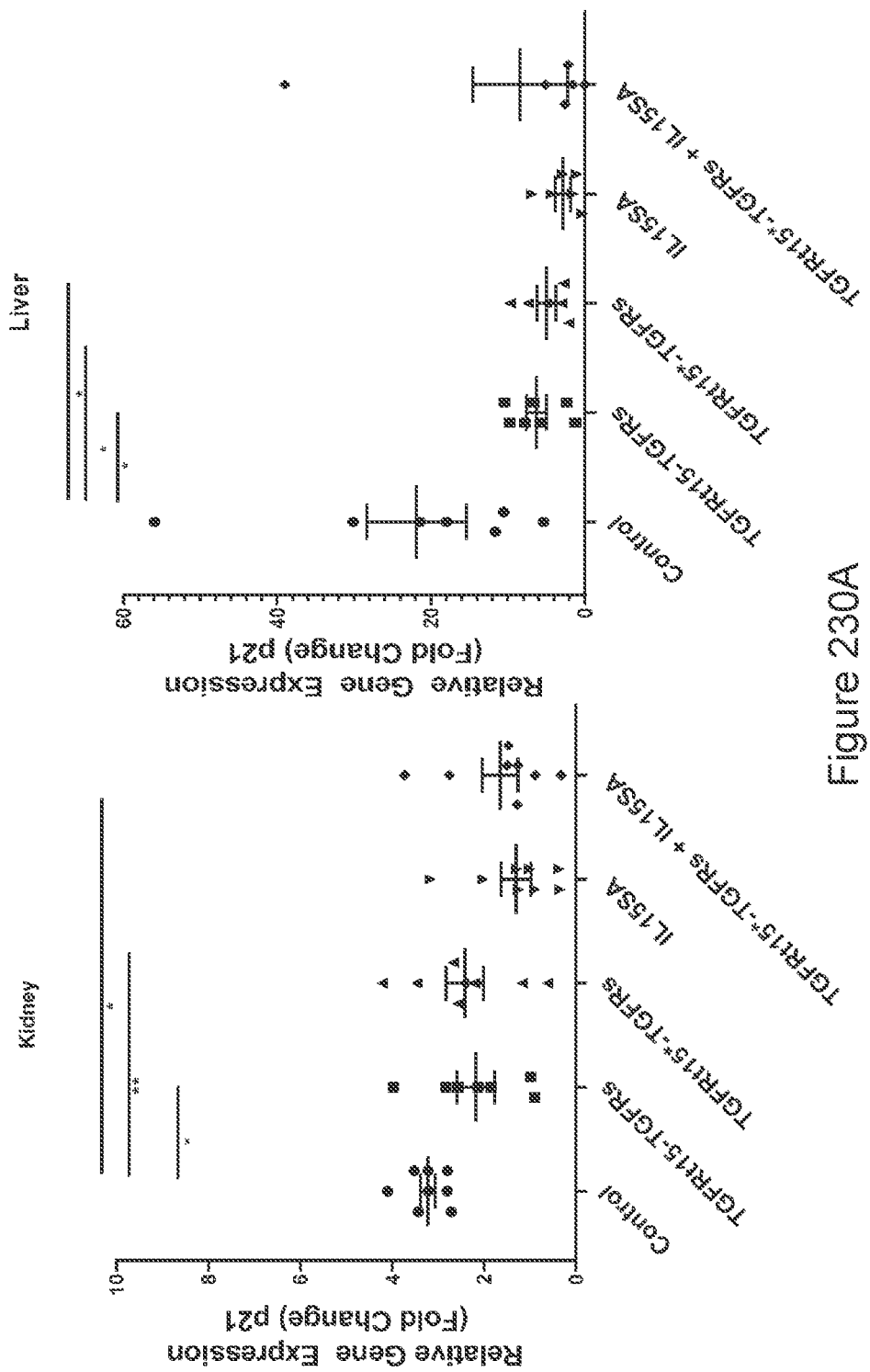

FIG. 230A shows gene expression of senescence marker p21, in kidney and liver tissues, post test article treatment.

Figure 230B:
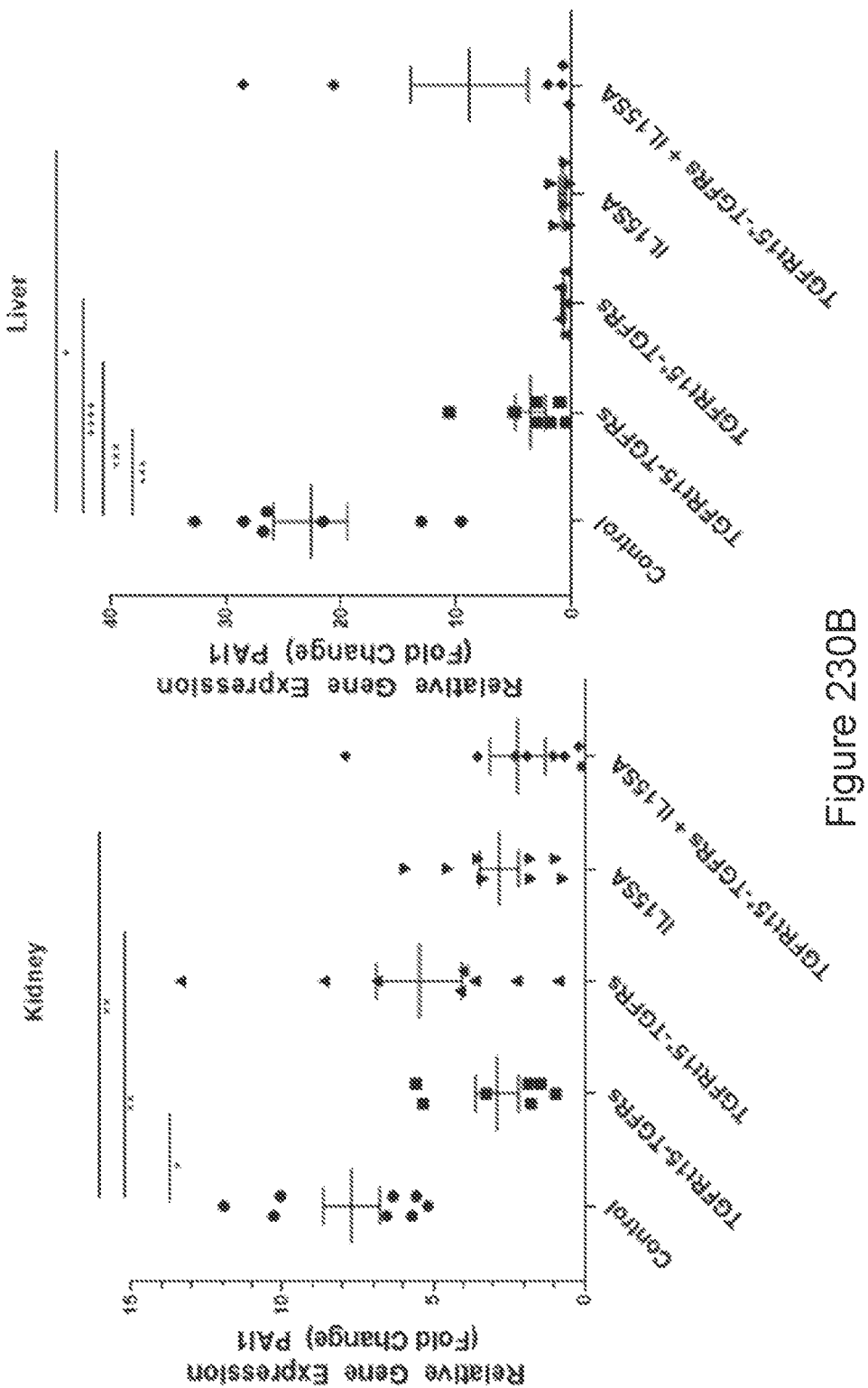

FIG. 230B shows gene expression of senescence marker PAI1, in kidney and liver tissues, post study treatment.

Figure 230C:
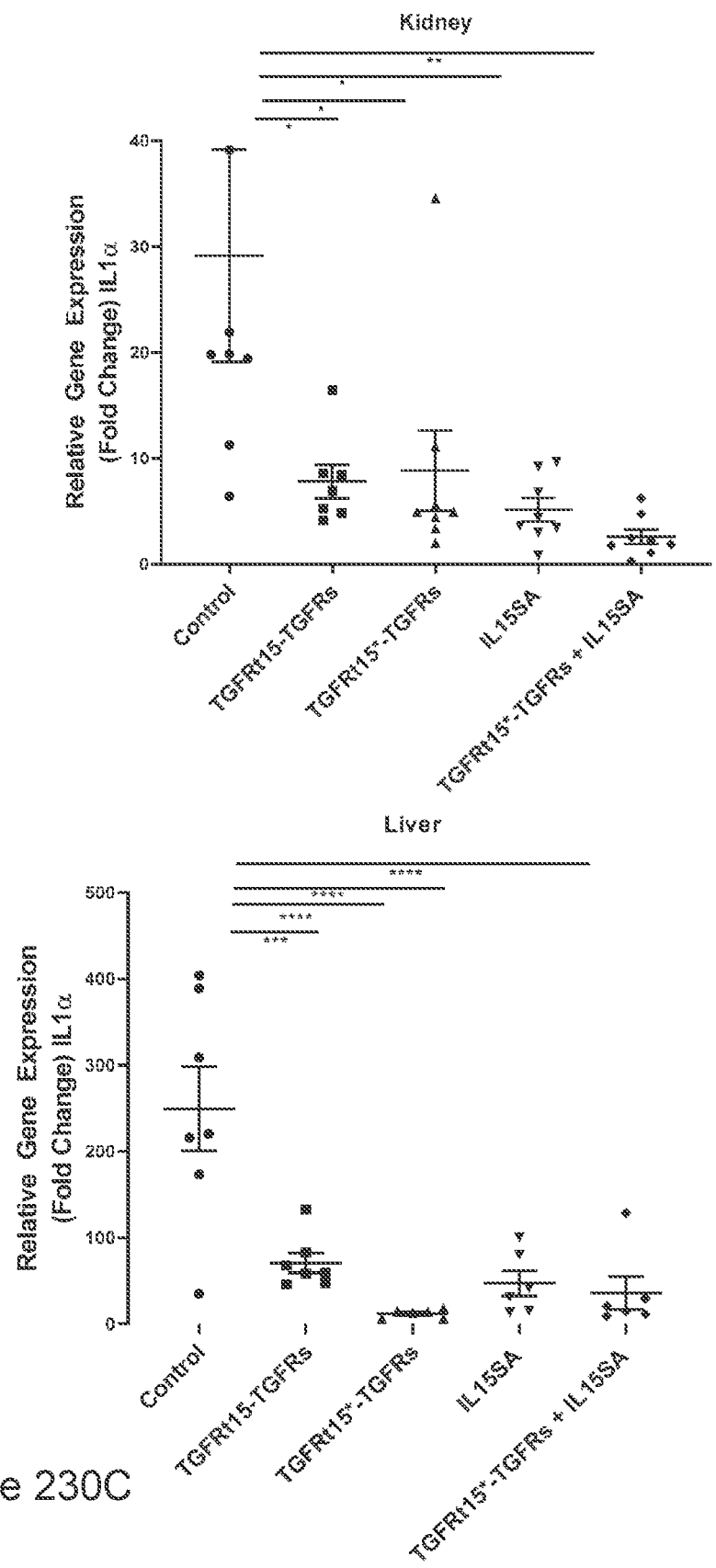

FIG. 230C shows gene expression of senescence marker IL-1α, in kidney and liver tissues, post study treatment.

Figure 230D:
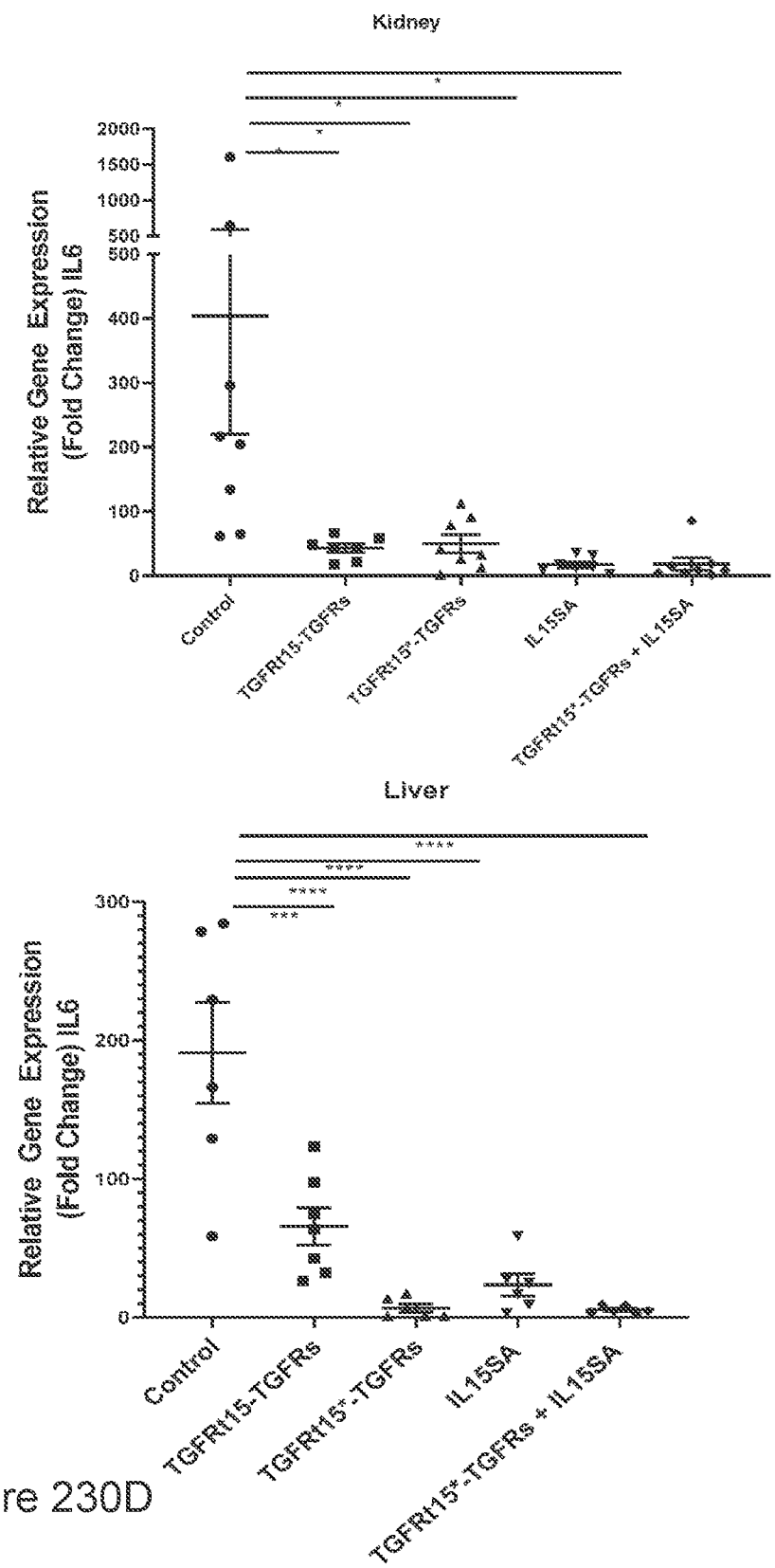

FIG. 230D shows gene expression of senescence marker IL-6, in kidney and liver tissues, post study treatment.

Figure 231A:
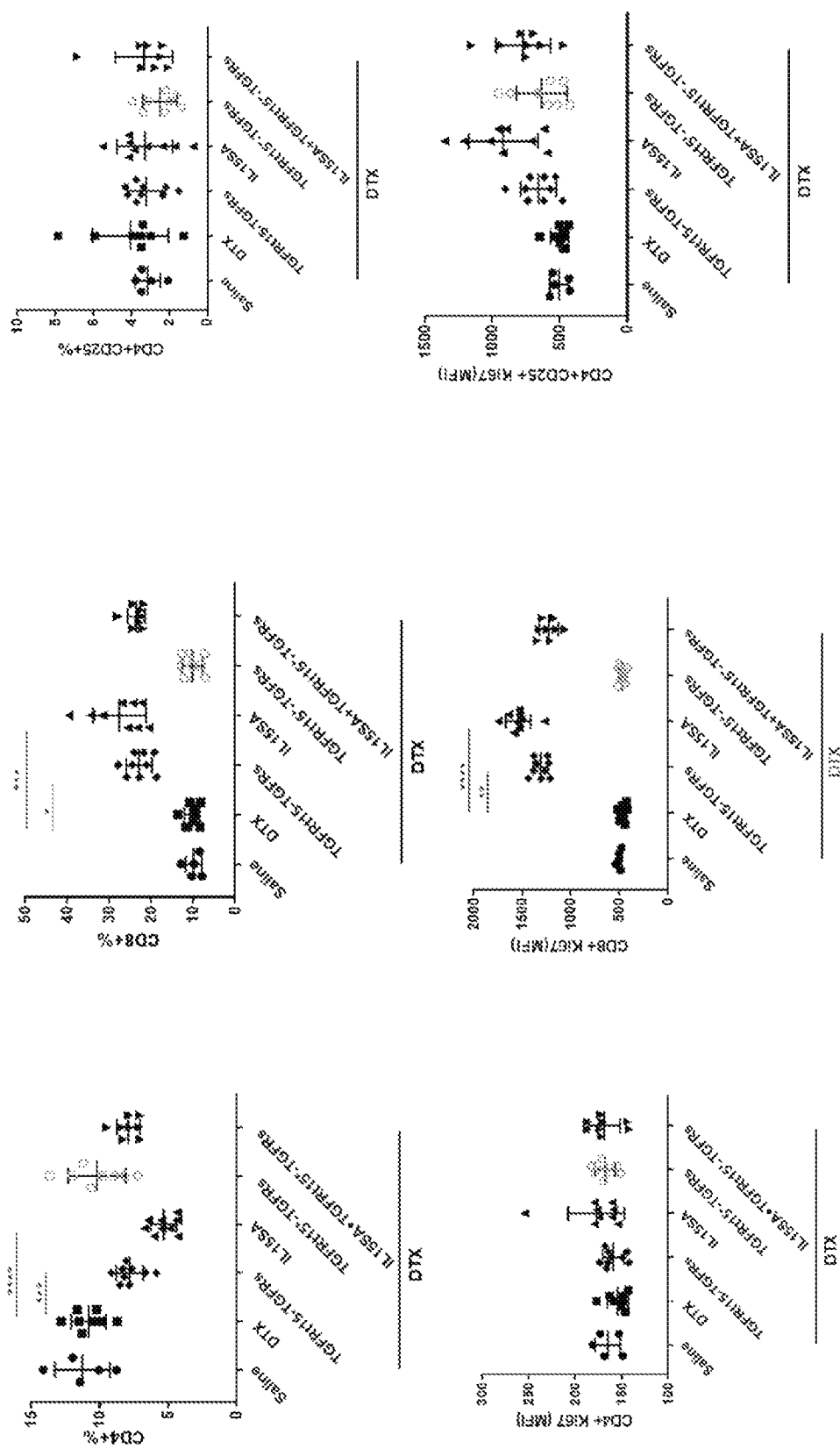

FIG. 231A shows CD4+, CD8+, and Treg cell percentages and proliferation following treatment with the agents shown.

Figure 231B:
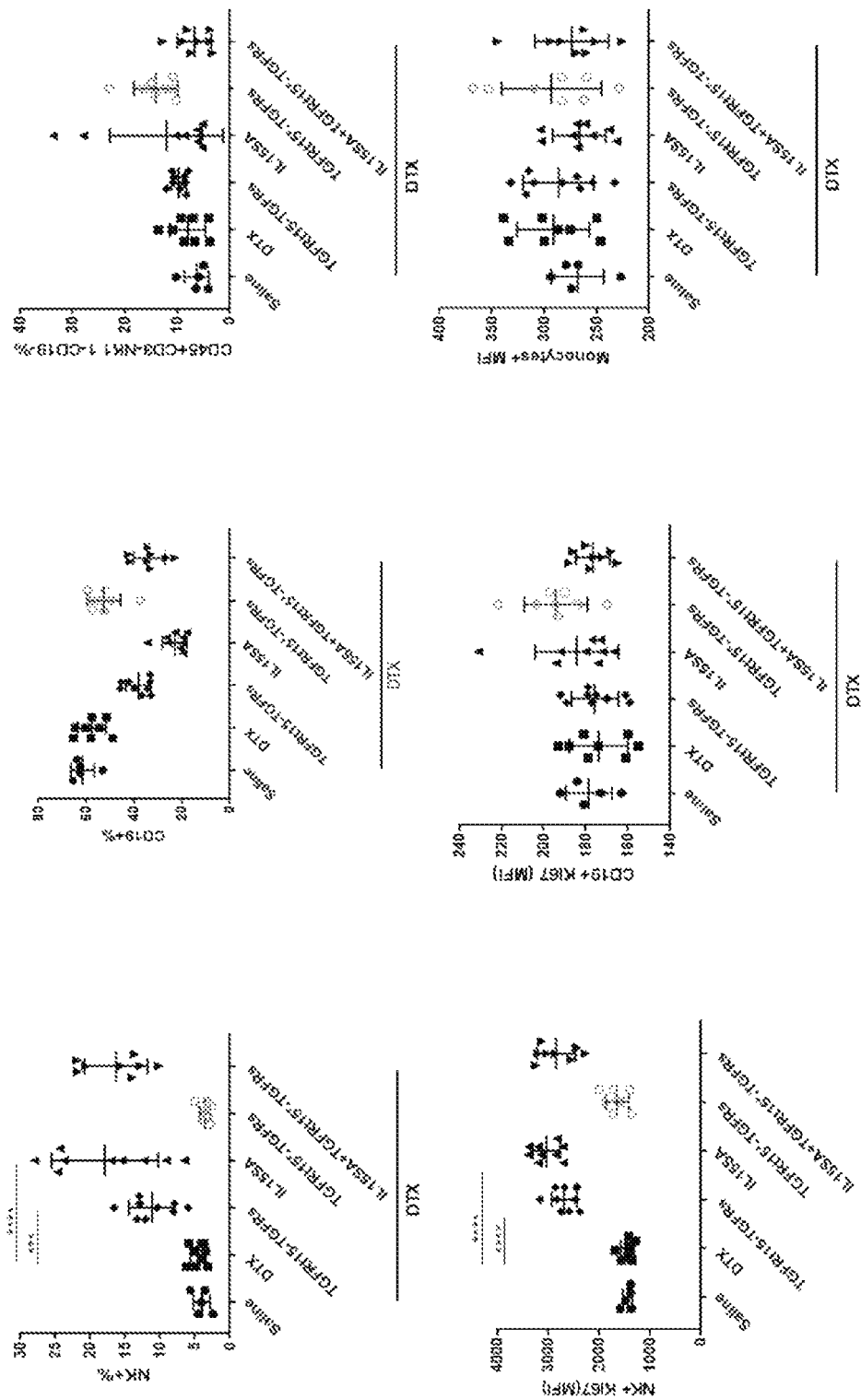

FIG. 231B shows NK, CD19+, and monocyte cell percentages and proliferation following treatment with the agents shown.

FIG. 232A shows evaluation of gene expression of senescence markers p21 in lung tissue of mice following chemotherapy and treatment with the agents shown.

FIG. 232B shows evaluation of gene expression of senescence marker CD26 in lung tissue of mice following chemotherapy and treatment with the agents shown.

FIG. 232C shows evaluation of gene expression of senescence marker p21 in liver tissue of mice following chemotherapy and treatment with the agents shown.

Figure 233A:
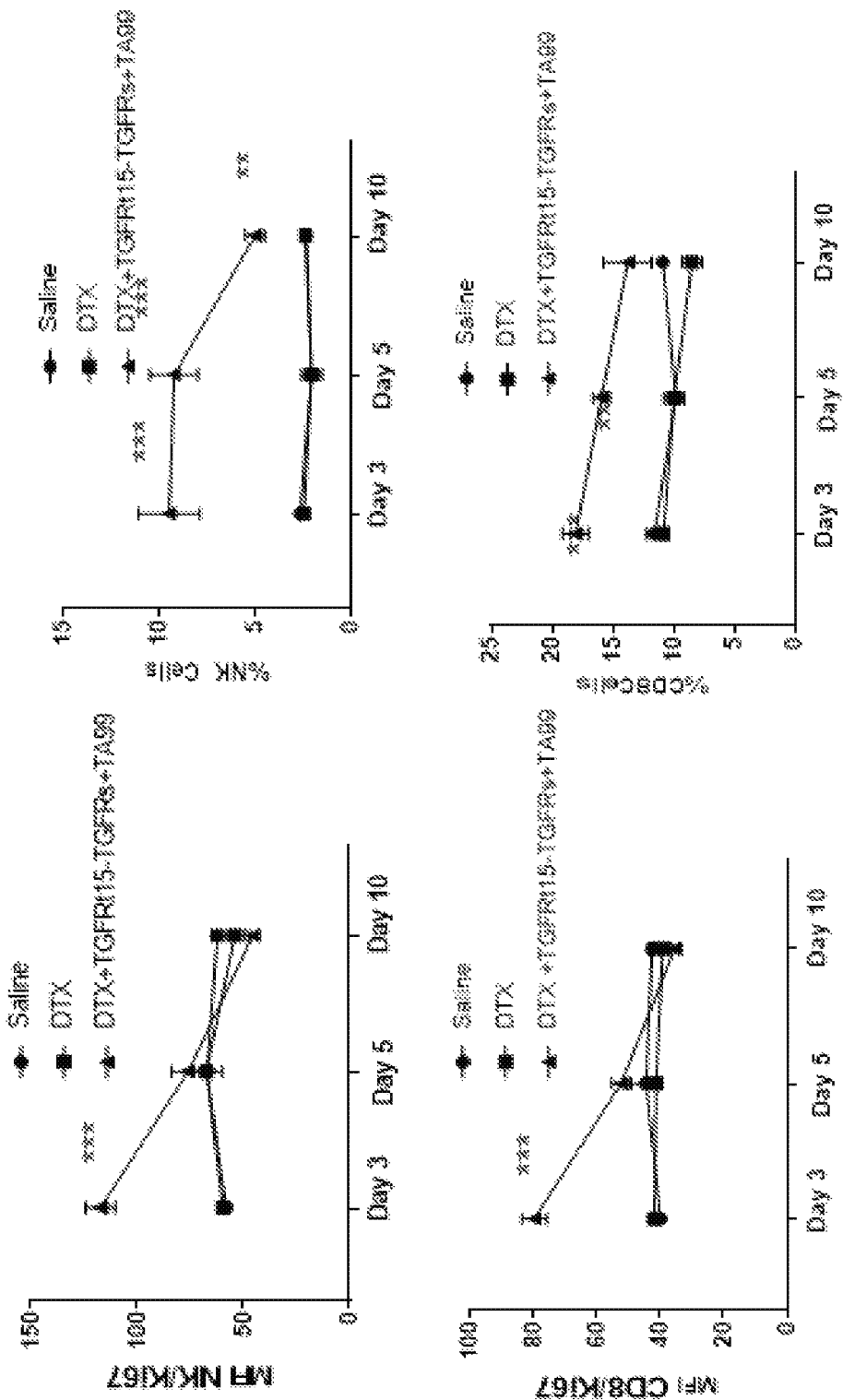
Figure 233B:
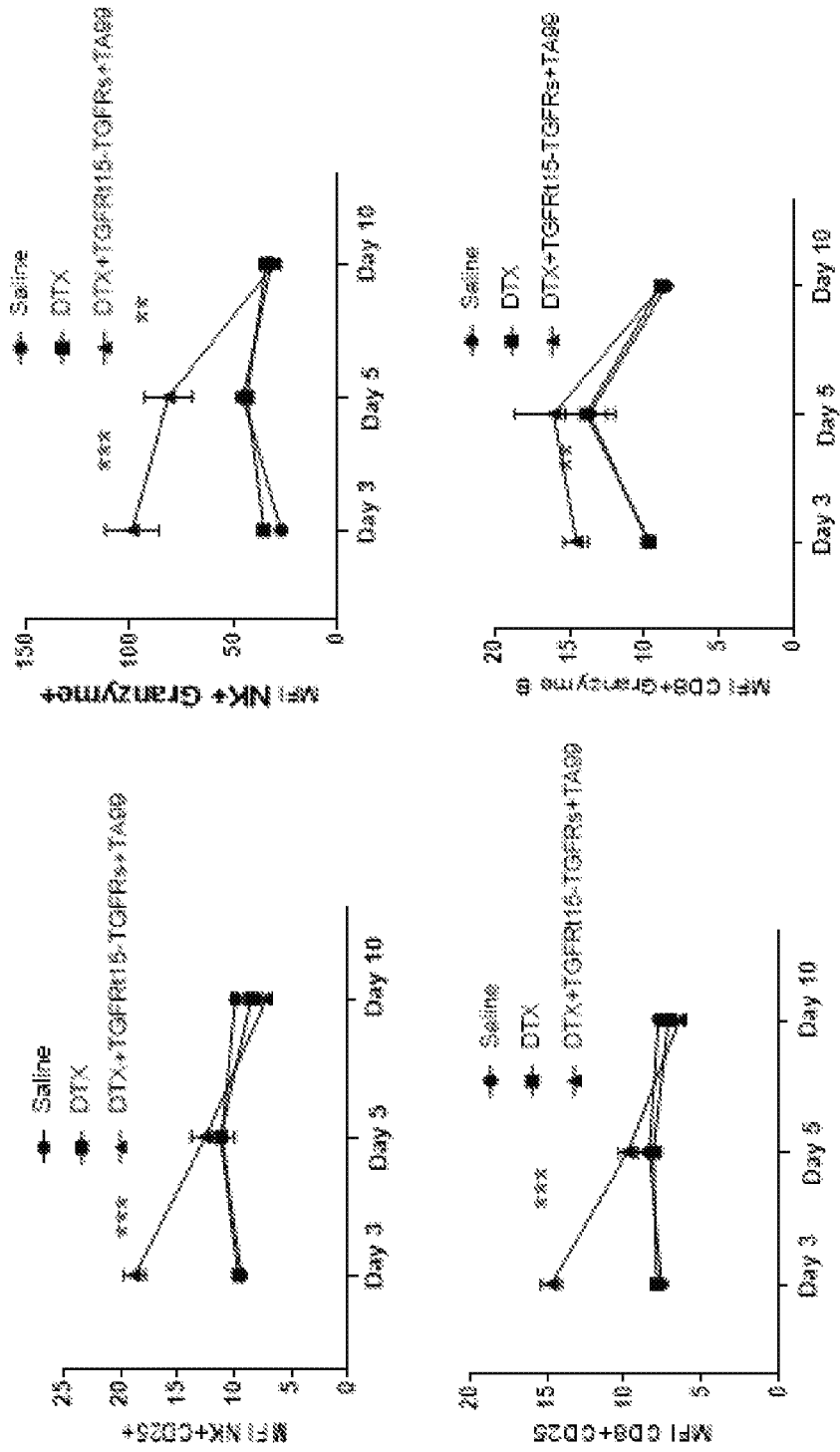

FIGS. 233A-B are graphs showing TGFRt15-TGFRs treatment enhances the immune cell proliferation, expansion and activation in the peripheral blood of B16F10 tumor bearing mice.

Figure 234:
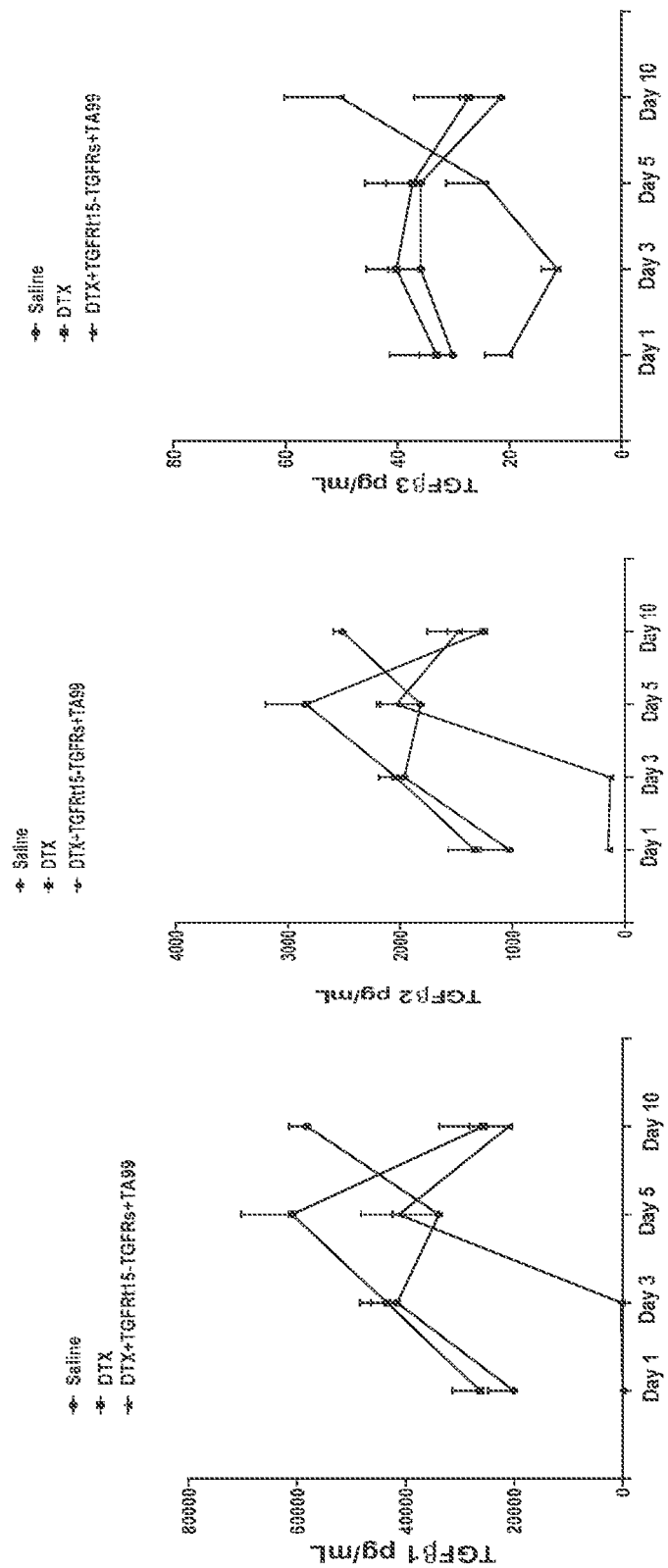

FIG. 234 are graphs showing TGFRt15-TGFRs treatment decreases levels of TGFβ in the plasma of B16F10 tumor bearing mice.

Figure 235:
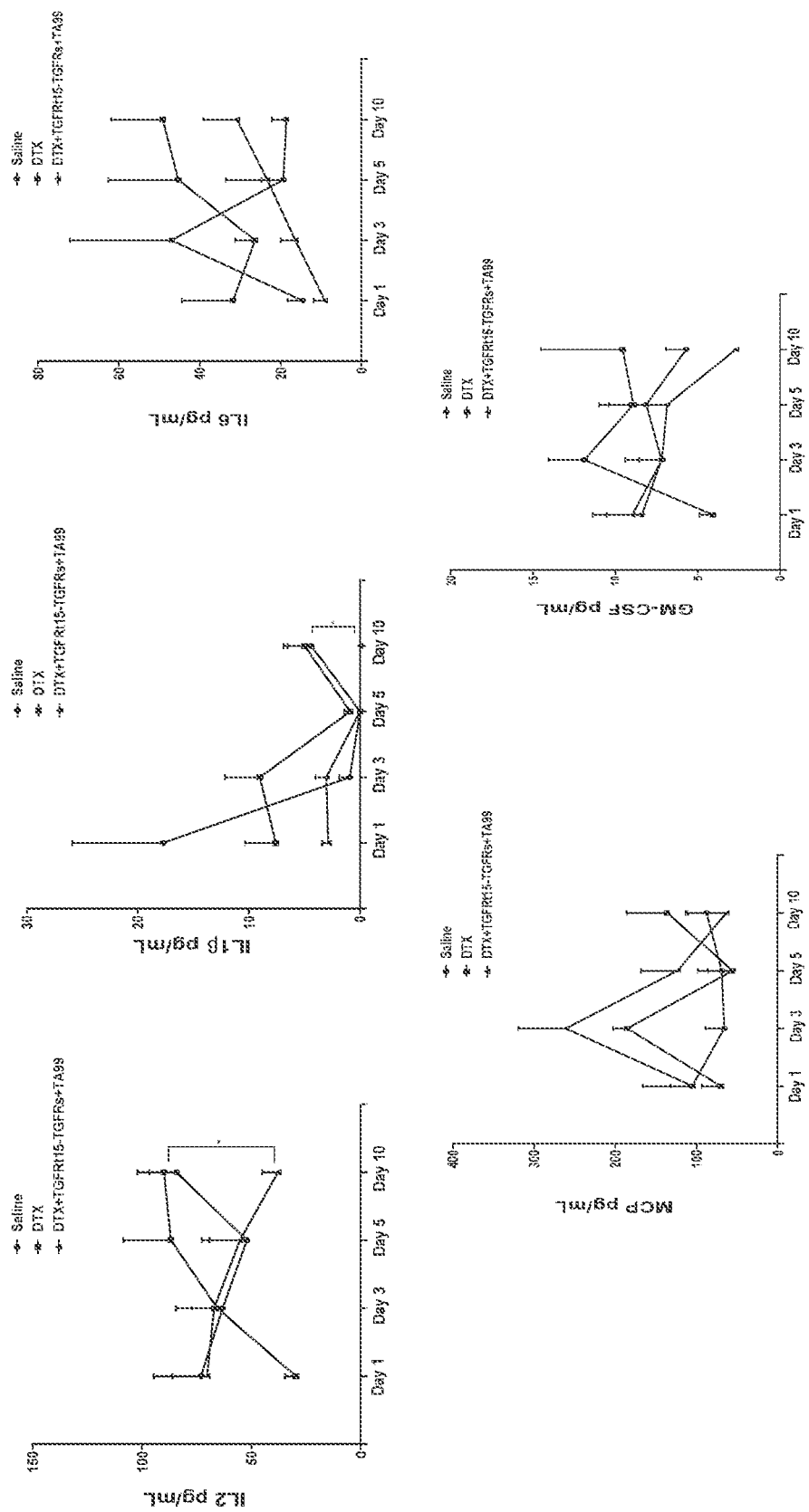

FIG. 235 are graphs showing TGFRt15-TGFRs treatment reduces levels of proinflammatory cytokines in the plasma of B16F10 tumor bearing mice.

FIG. 236 shows TGFRt15-TGFRs treatment enhances NK and CD8 expansion in the spleen of B16F10 tumor bearing mice.

Figure 237A:
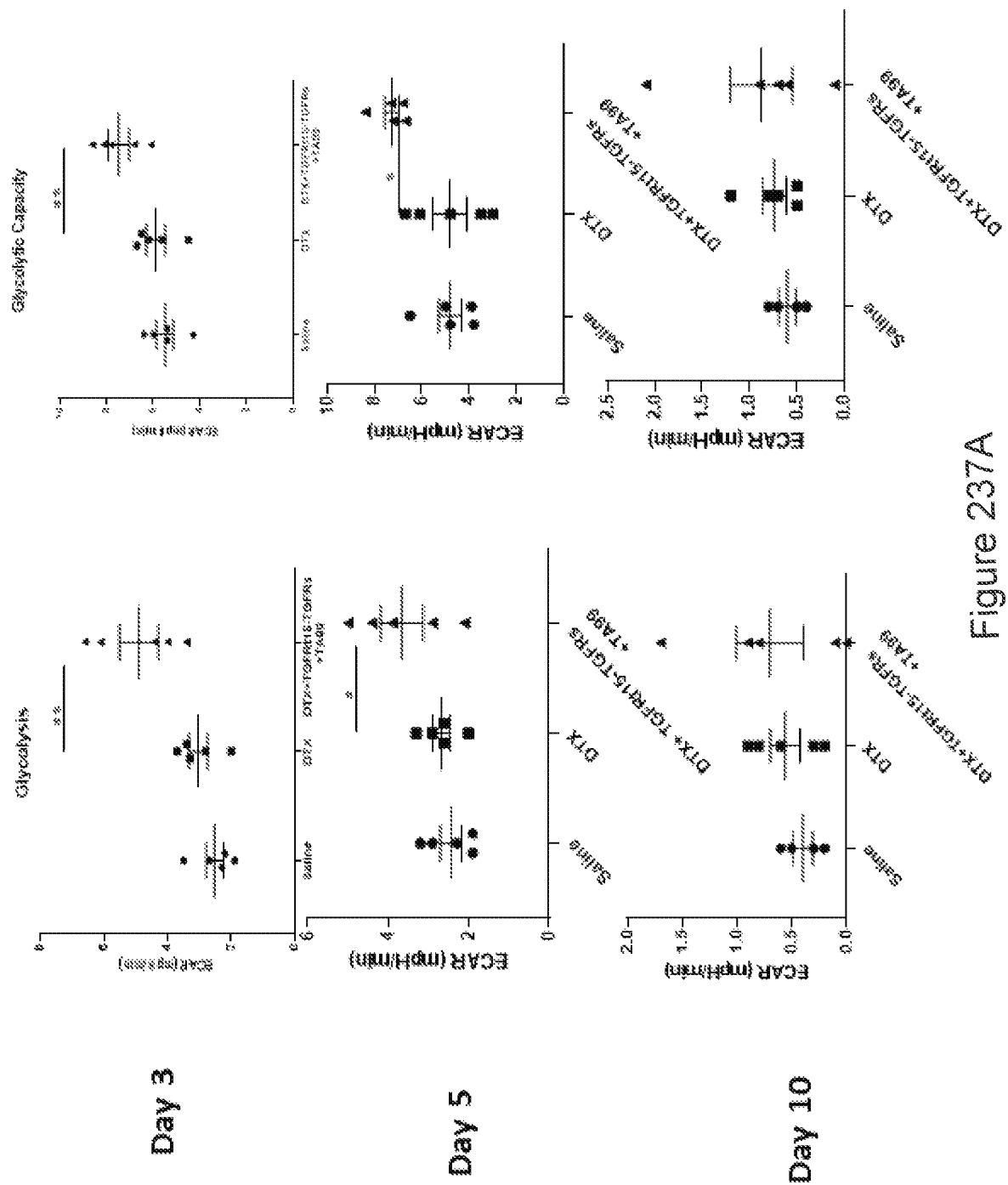
Figure 237B:
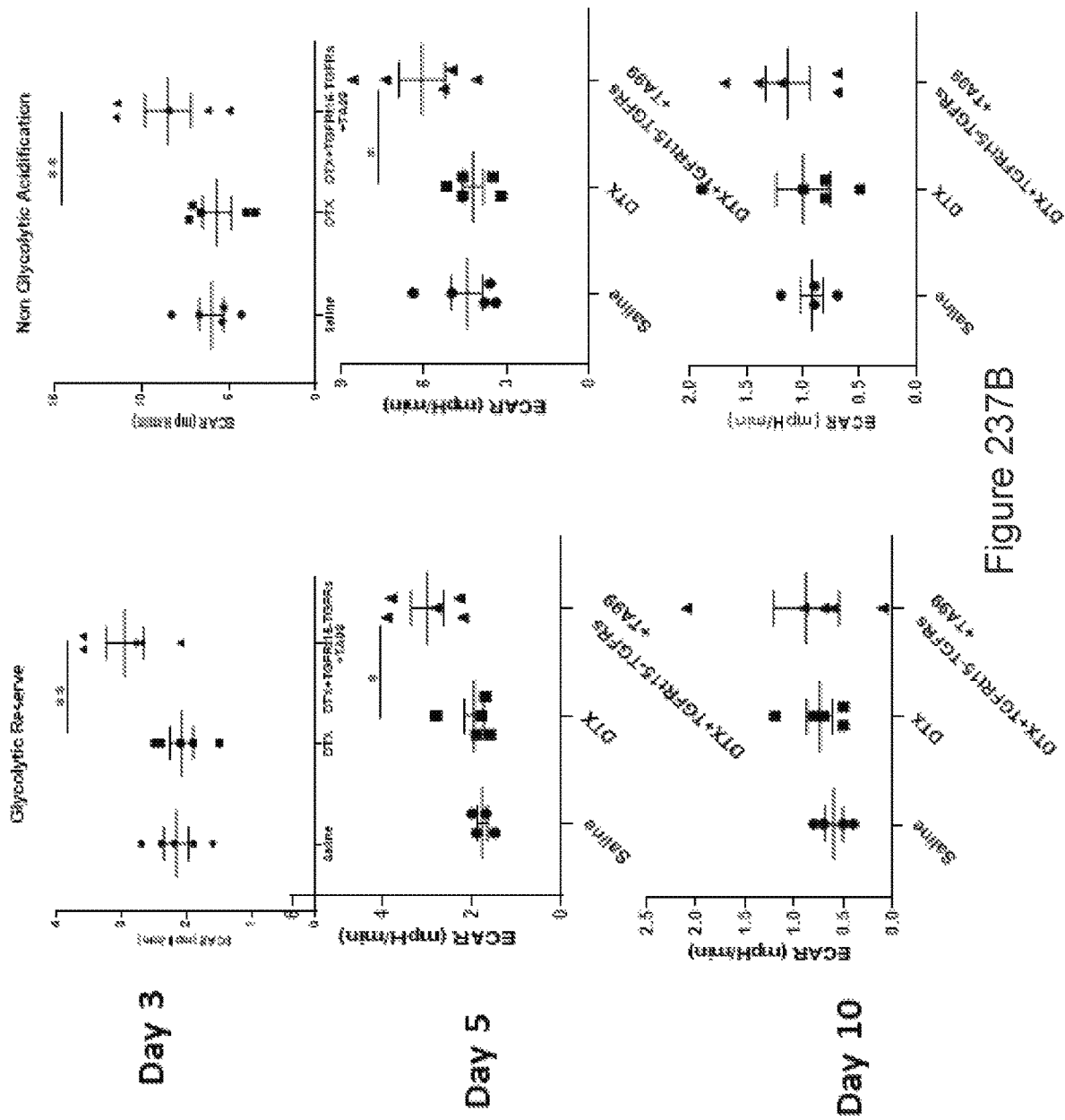

FIGS. 237A-B show TGFRt15-TGFRs treatment enhances glycolytic activity of splenocytes in B16F10 tumor bearing mice.

Figure 238A:
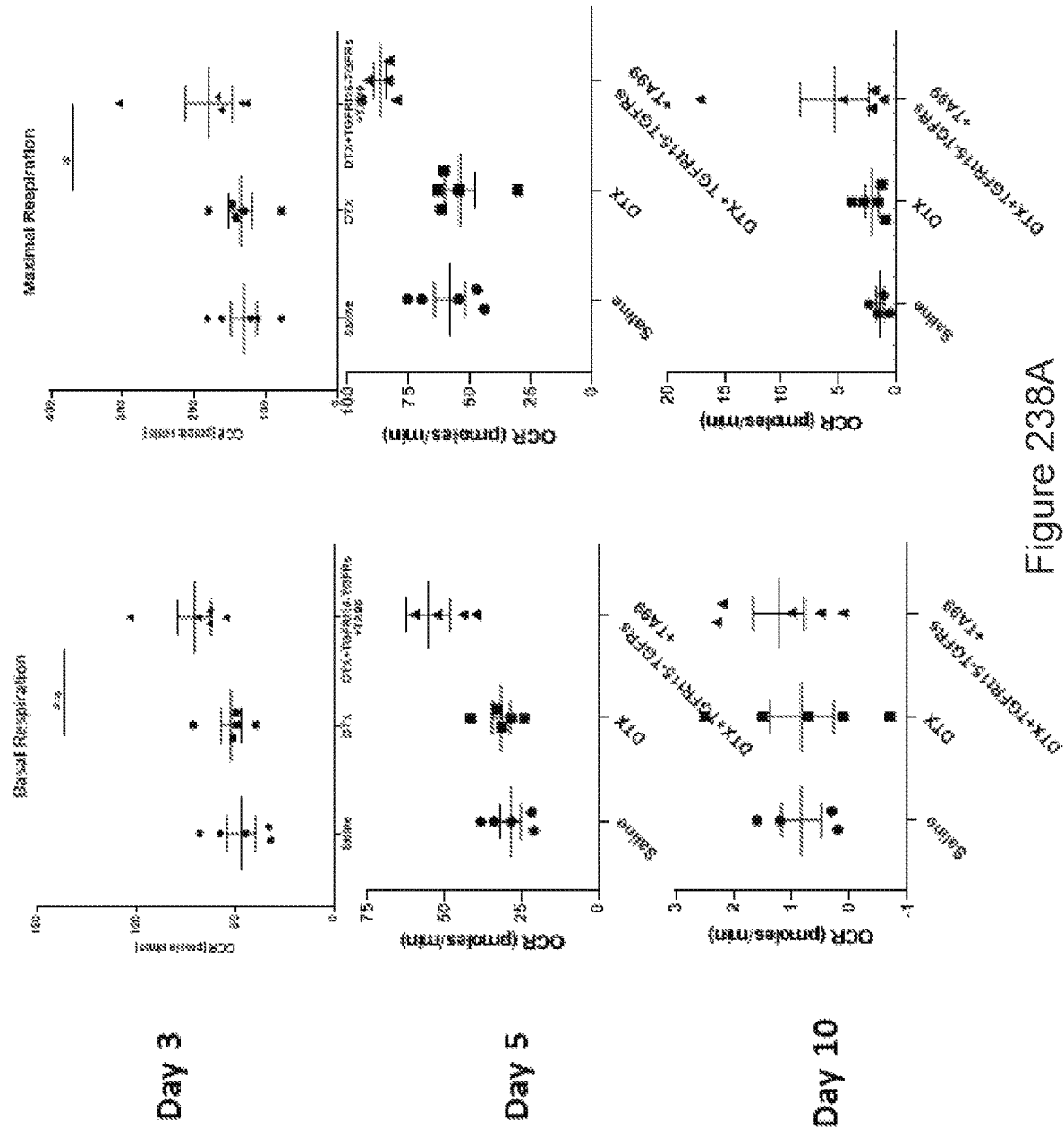
Figure 238B:
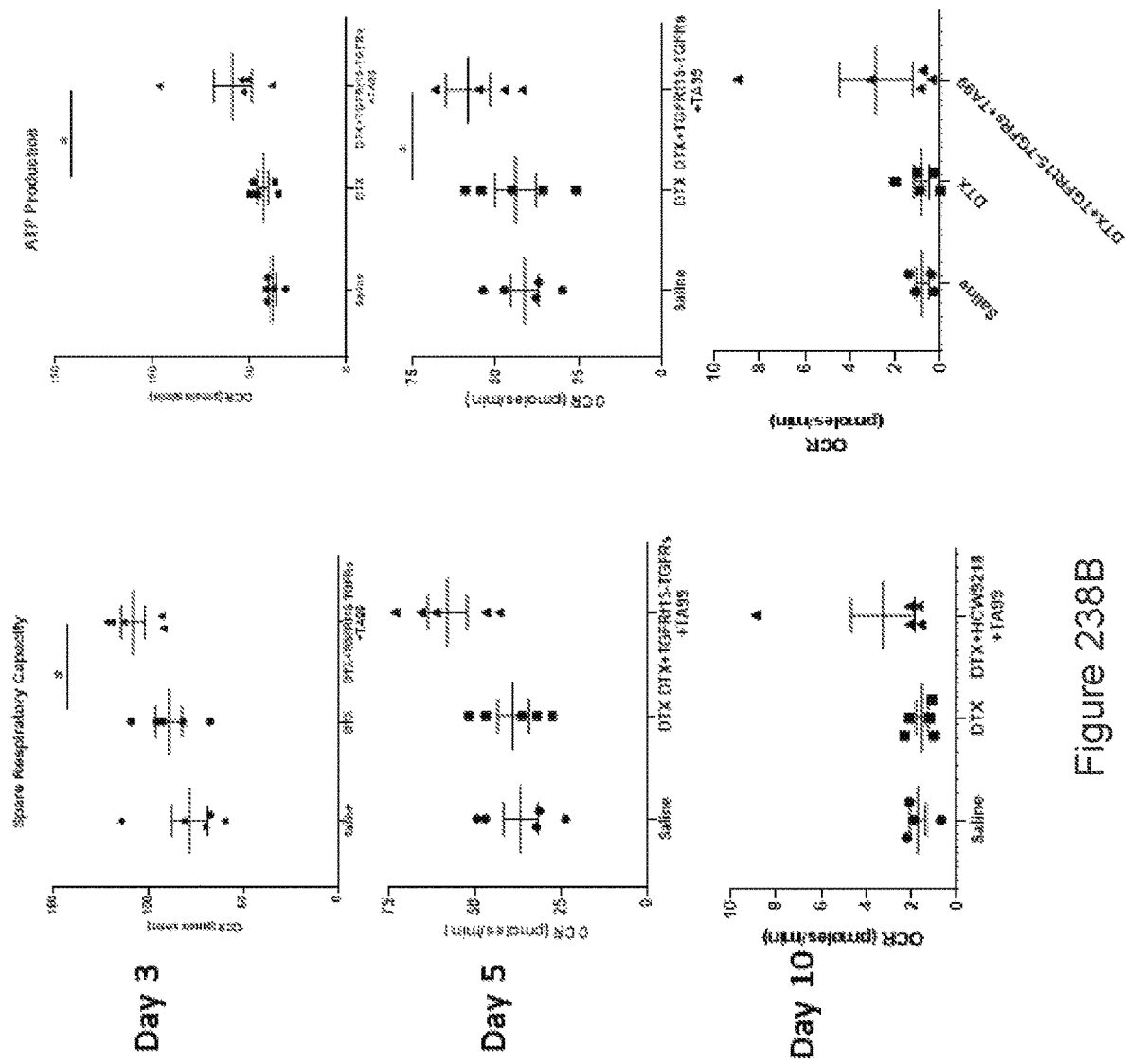

FIGS. 238A-B show TGFRt15-TGFRs treatment enhances mitochondrial respiration of splenocytes in B16F10 tumor bearing mice.

Figure 239A:
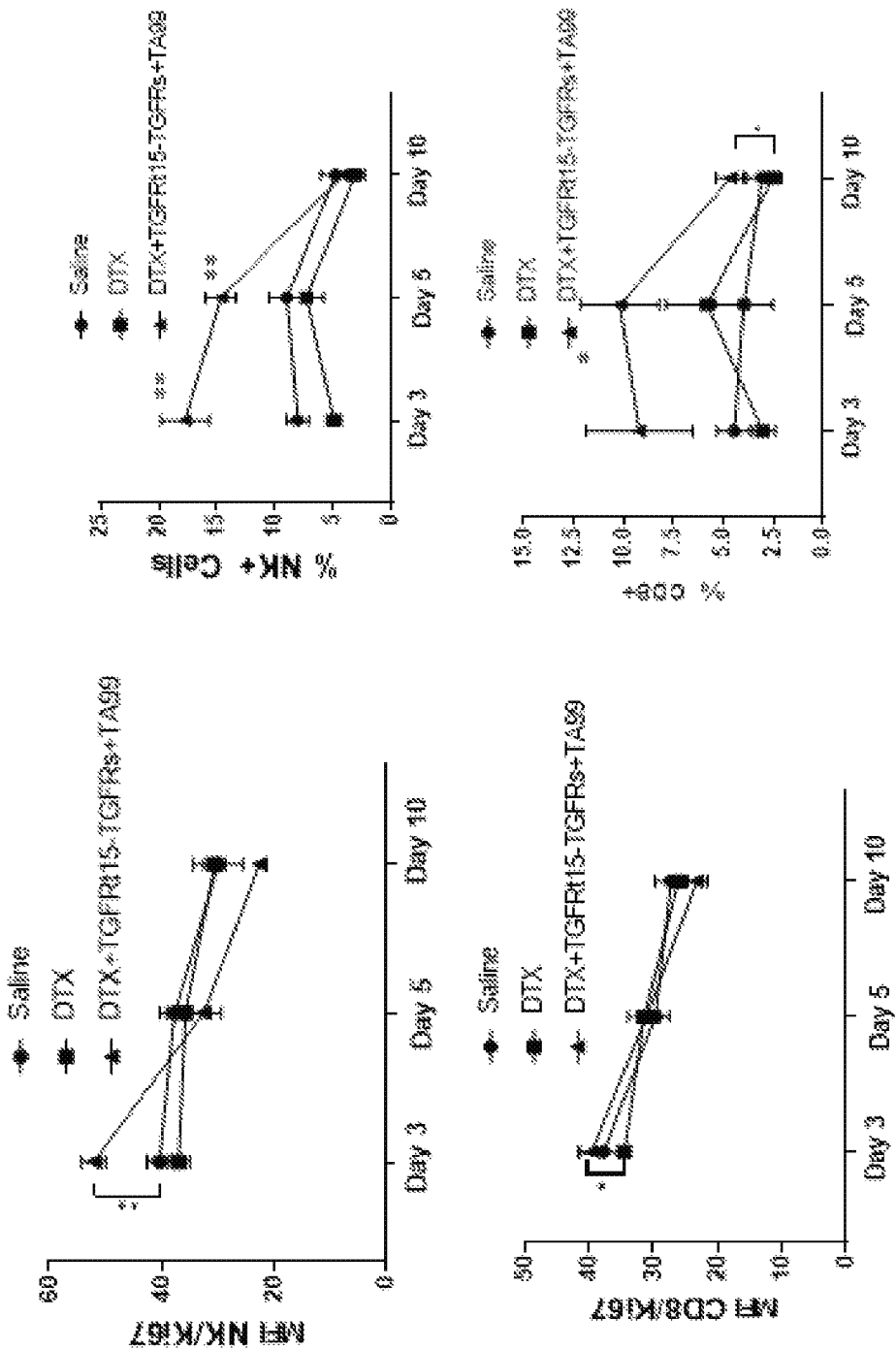
Figure 239B:
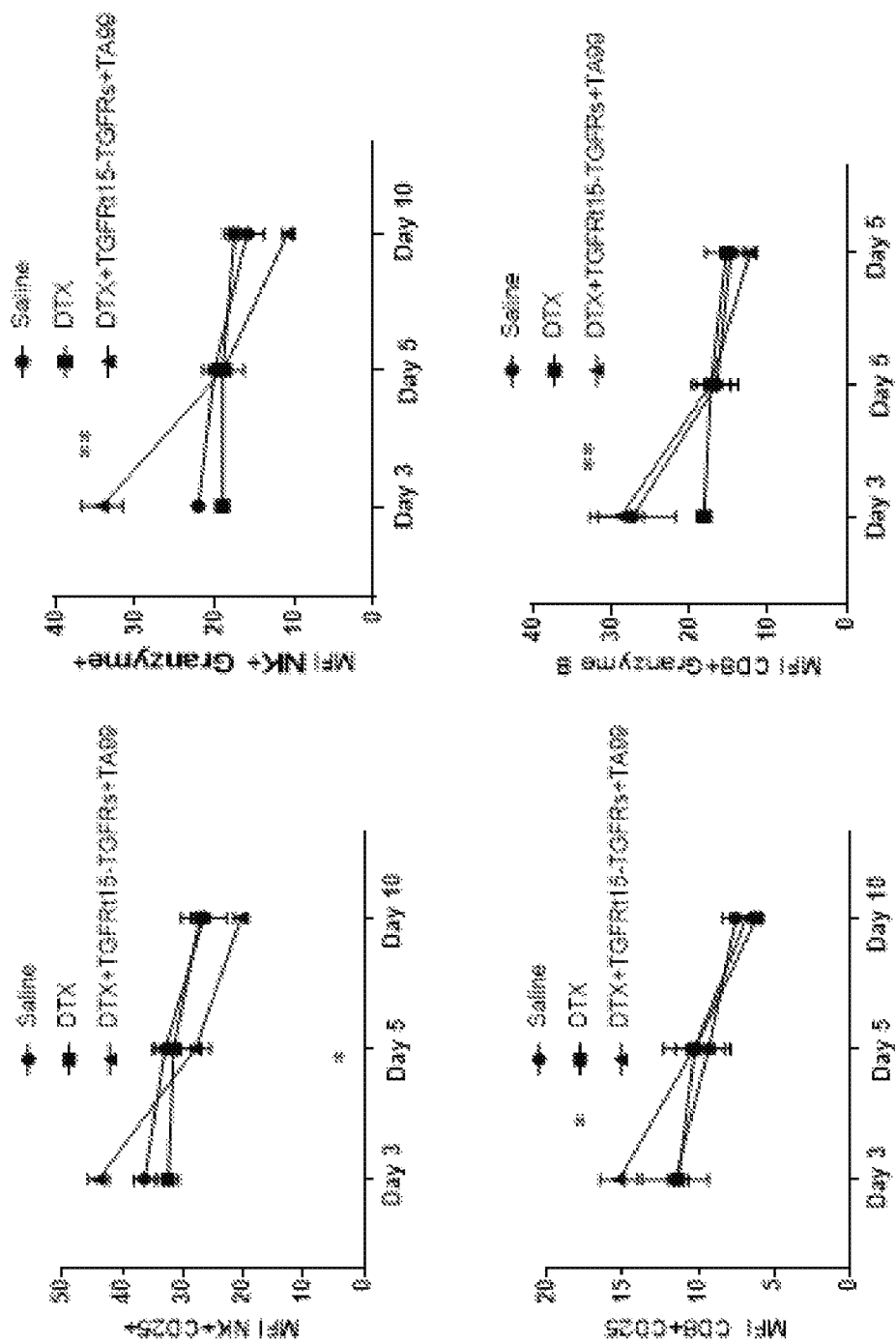

FIGS. 239A-B show TGFRt15-TGFRs treatment enhances NK and CD8 immune cell infiltration (TILs) into tumors of B16F10 tumor bearing mice.

Figure 240:
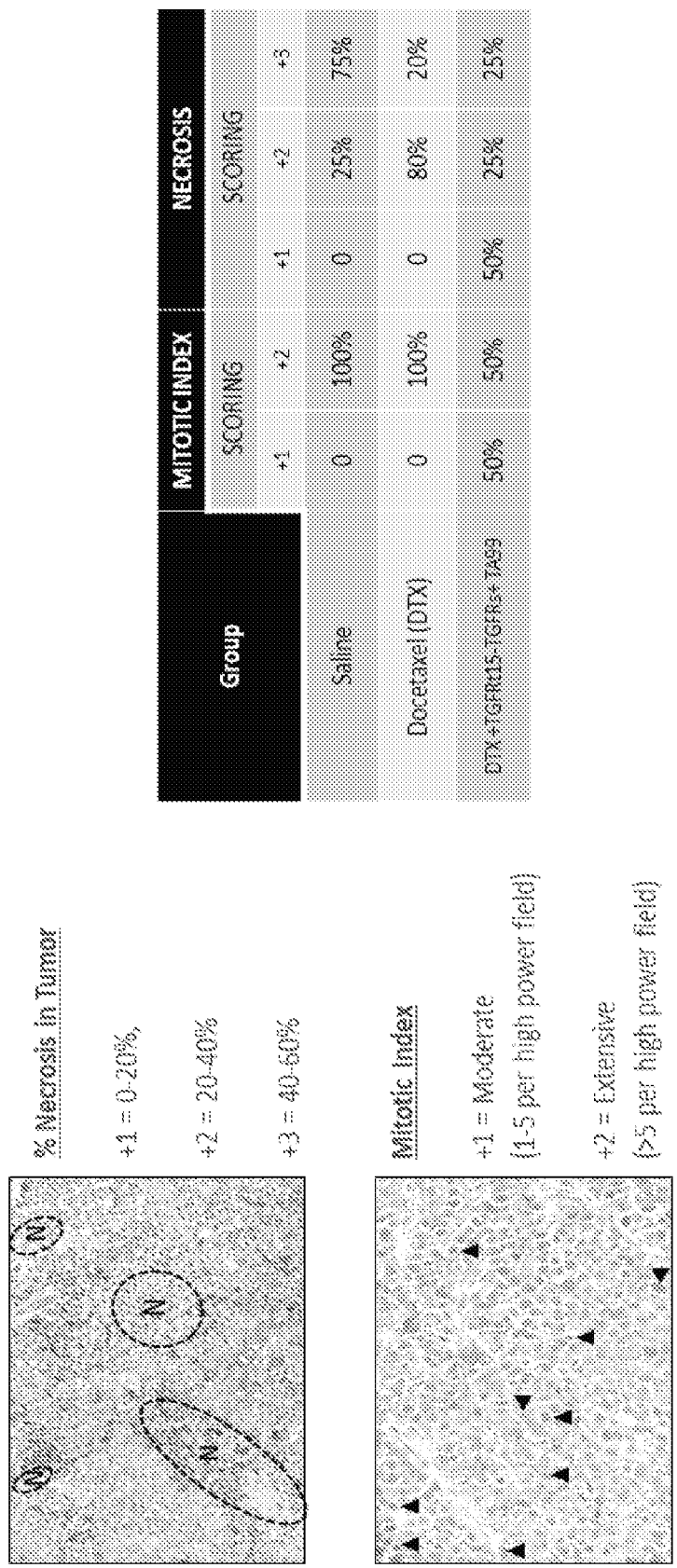

FIG. 240 shows histopathological analysis of tumors following TGFRt15-TGFRs treatment, wherein following TGFRt15-TGFRs+TA99 antibody treatment, tumors displayed less mitotic and necrotic activity. The mitotic index is correlated to the dividing cells and presence of necrosis is a measure of more aggressive features and poor prognosis.

Figure 241:
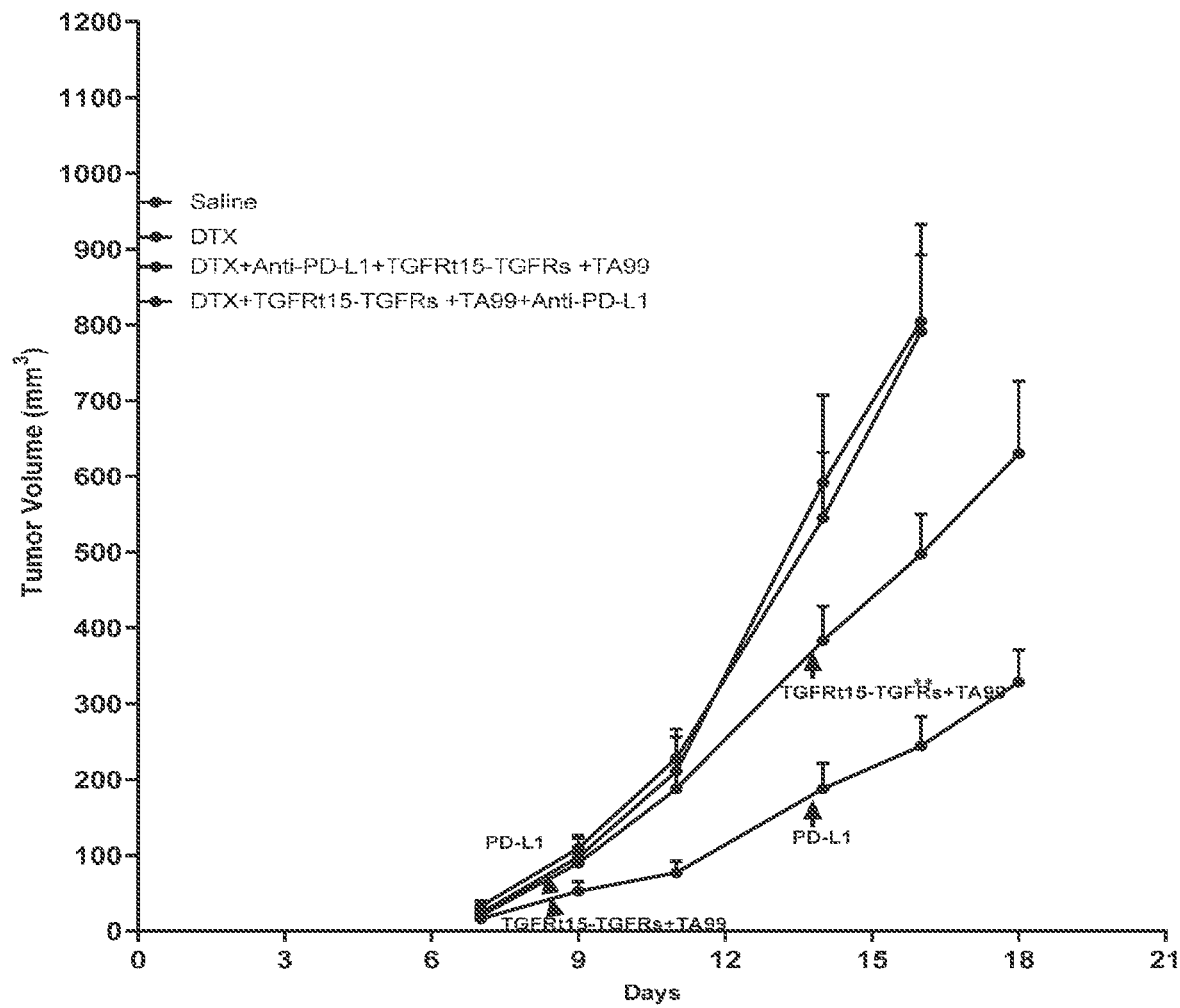

FIG. 241 is a graph showing anti-PD-L1 antibody in combination with TGFRt15-TGFRs+TA99 antibody and chemotherapy in B16F10 melanoma mouse model.

Figure 242:
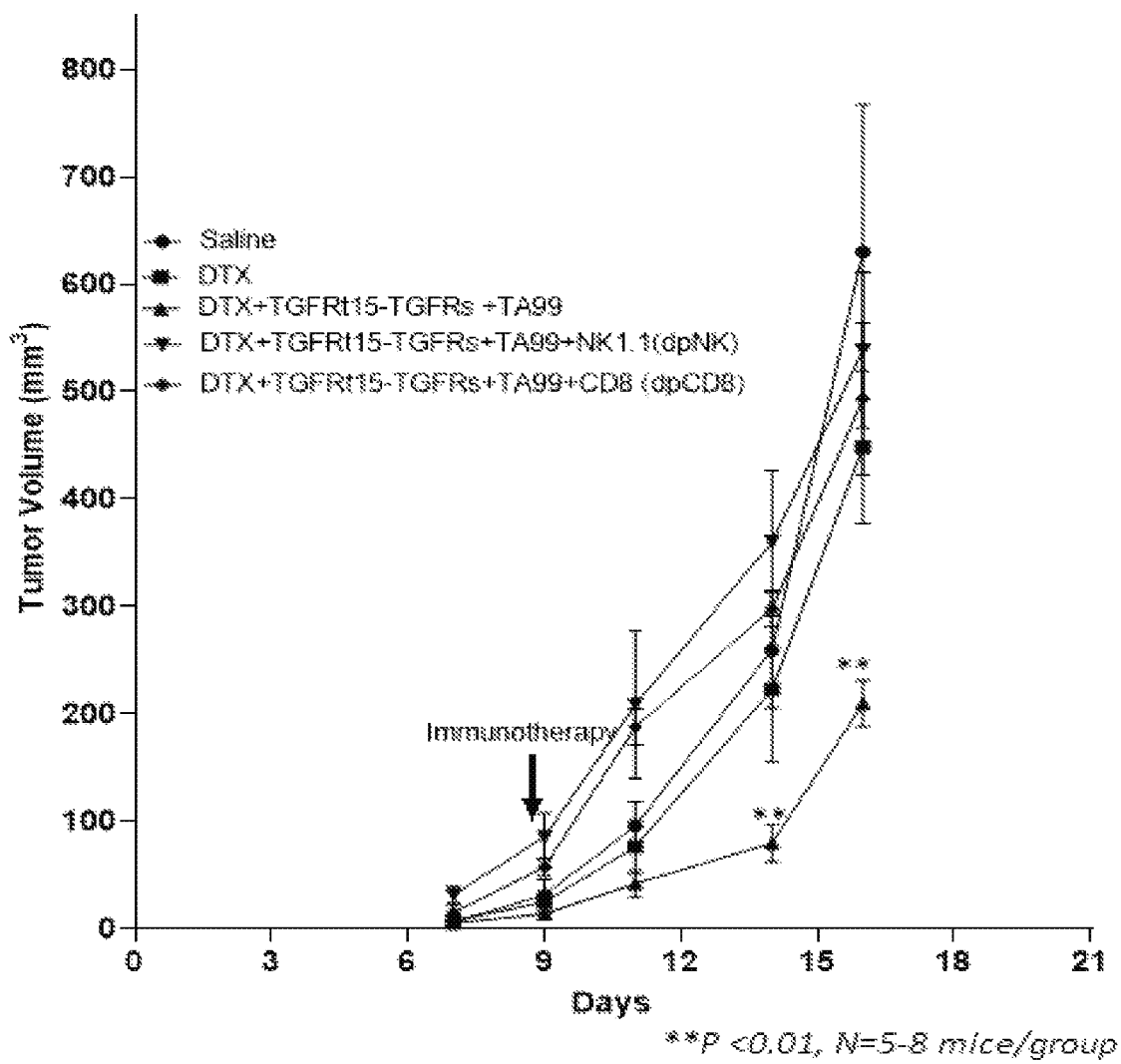

FIG. 242 is a graph showing that anti-tumor efficacy of TGFRt15-TGFRs in B16F10 melanoma mouse model is dependent on NK and CD8 T cells.

FIGS. 243A-B are graphs showing gene expression of senescence markers p21, IL-1α and IL6 in liver and lung tissues of tumor bearing mice following chemotherapy.

Figure 244:
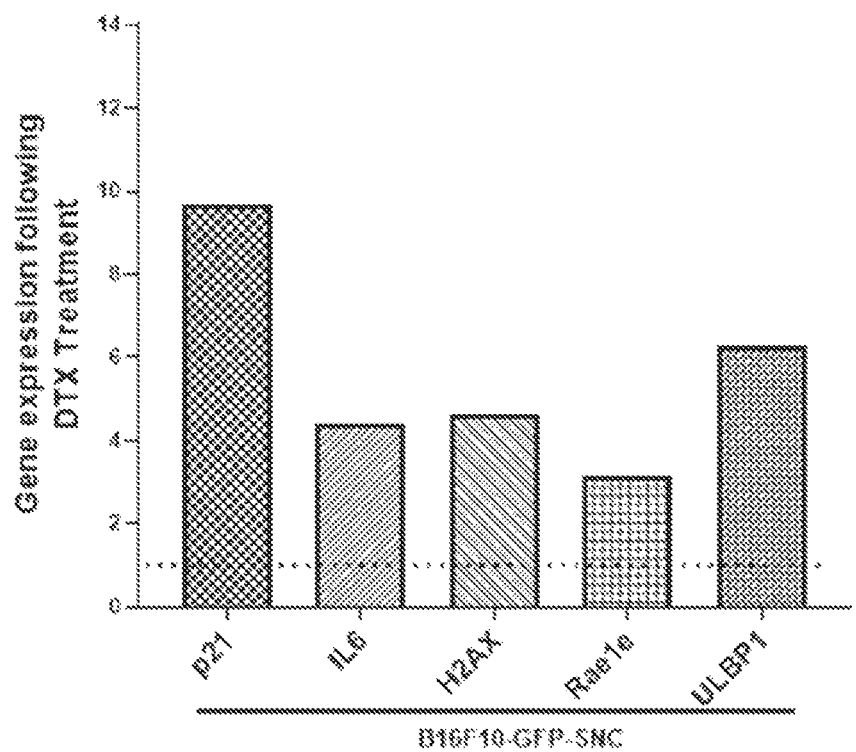

FIG. 244 is a graph showing induction of gene expression of senescence markers p21, IL6, H2AX, and NK cell ligands, Raele and ULBP1 by docetaxel treatment of B16F10 GFP cells.

Figure 245:
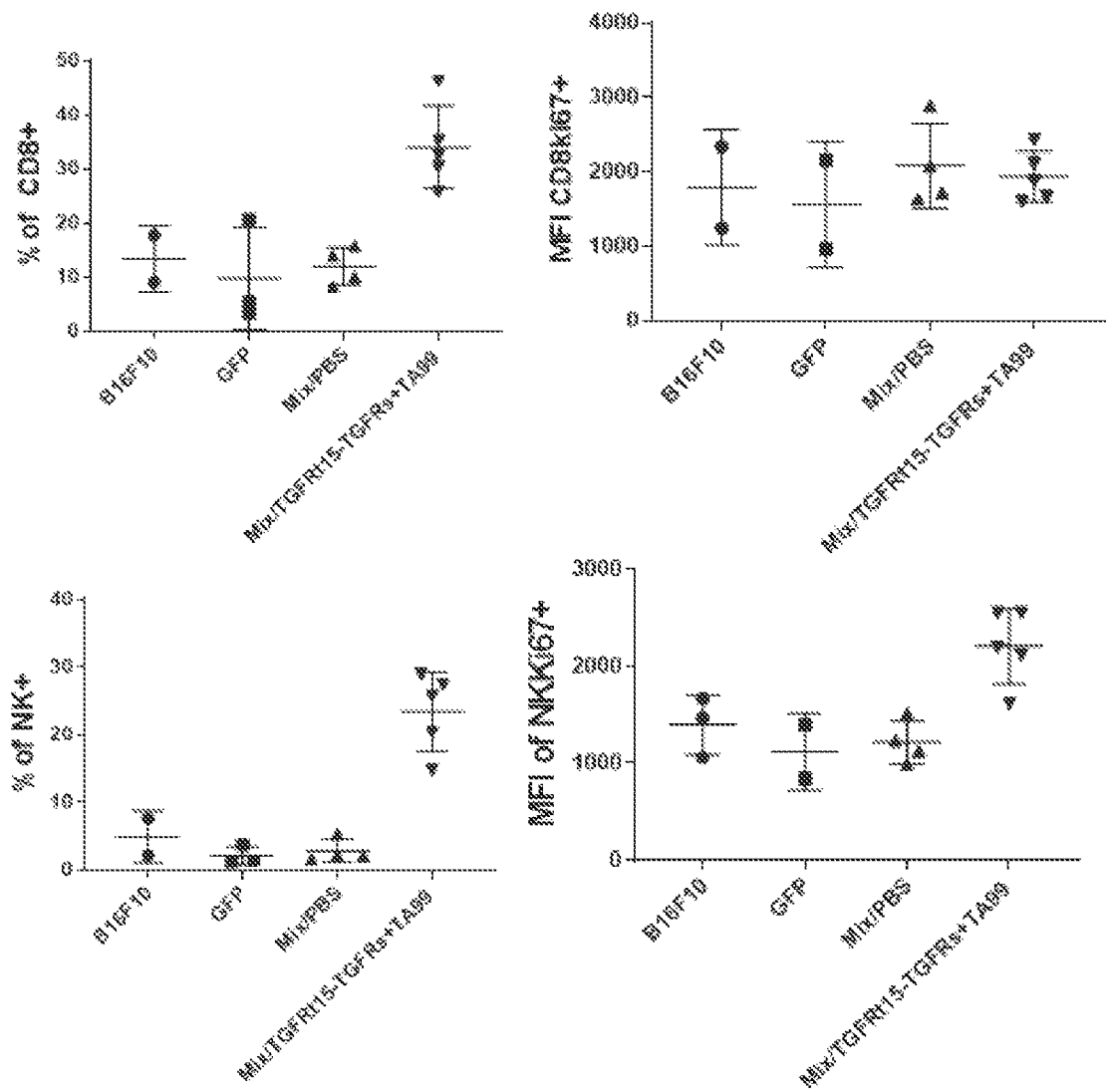

FIG. 245 shows tumor infiltrating lymphocytes/day after 4 days post treatment in tumor bearing mice.

Figure 246A:
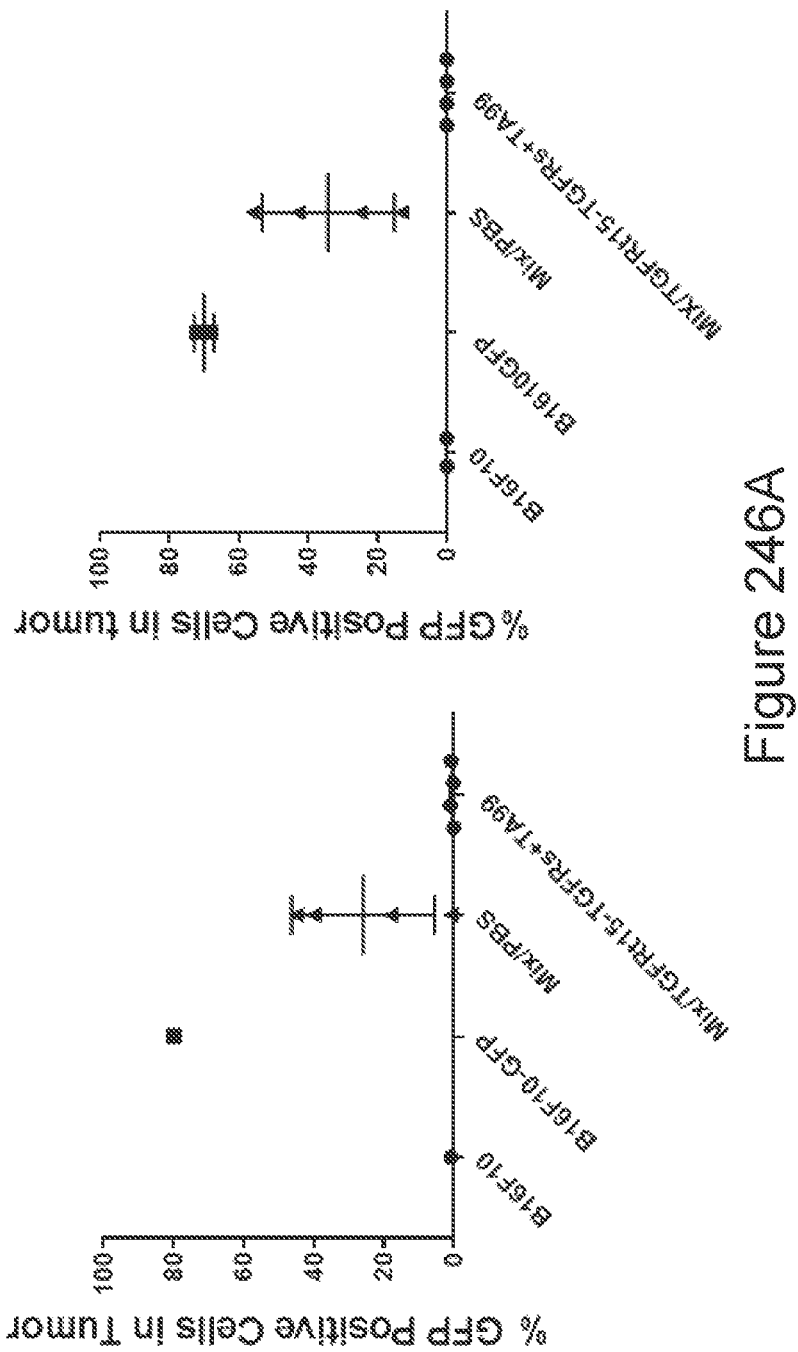
Figure 246B:
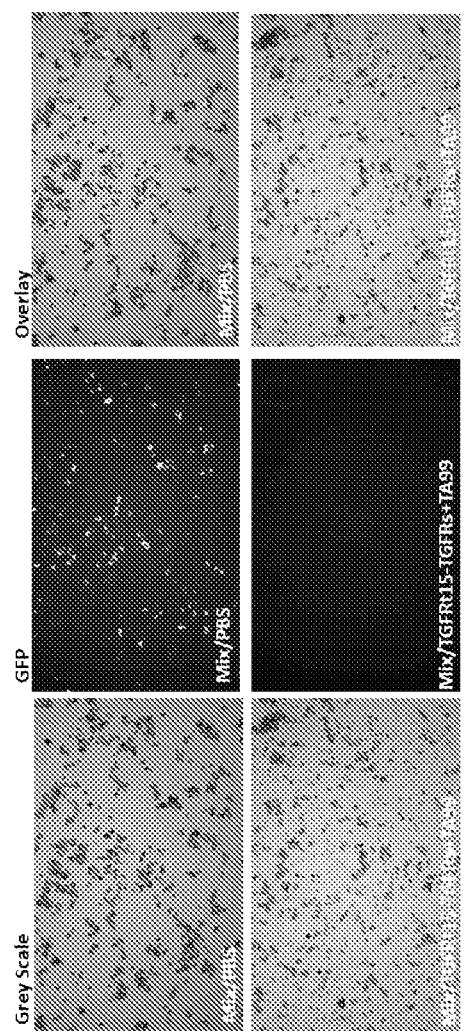

FIGS. 246A-B show flow cytometry analysis on tumor cells indicating that mice which received immunotherapy treatment showed lower number of GFP positive senescent tumor cells post 4 days and 10 days of treatment as compared to the PBS control group (FIG. 246A), and tumor cells plated in 24 well plate evaluated by fluorescence microscopy (FIG. 246B).

Figure 247:
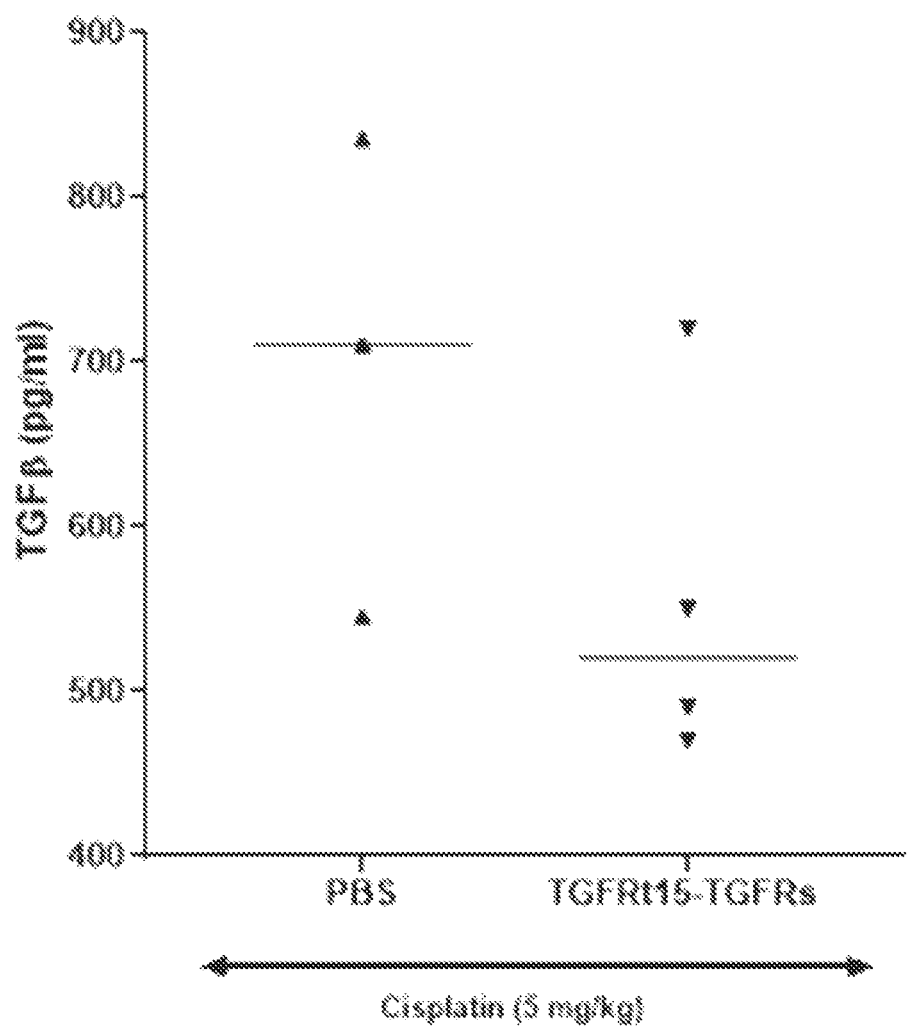

FIG. 247 shows TGFβ levels in kidney of mice after inducing kidney injury with cisplatin and treatment with TGFRt15-TGFRs.

Figure 248B:
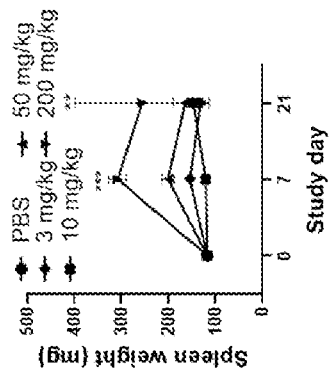
Figure 248A:
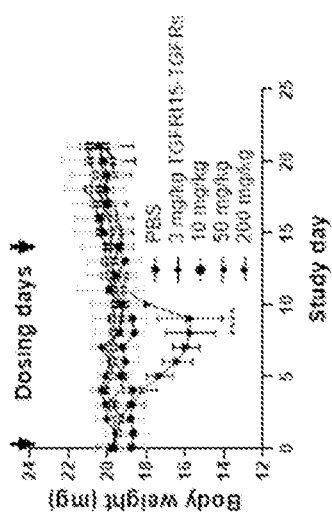
Figure 248C:
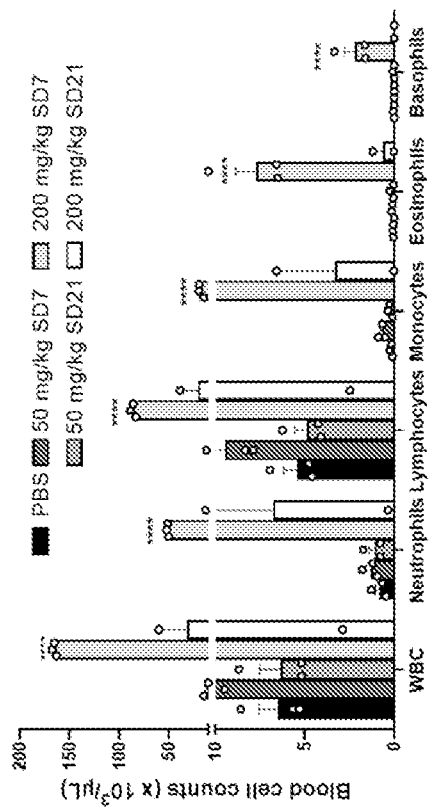

FIGS. 248A-C show the toxicological effects of repeat dose subcutaneous administration of TGFRt15-TGFRs in C57BL/6 mice. Changes in body weights are shown through SD21 (FIG. 248A). Spleen weights (FIG. 248B) and blood cells counts and differentials (FIG. 248C) are indicated for mice at SD7 after one dose and SD21 after two doses of TGFRt15-TGFRs.

Figure 249:
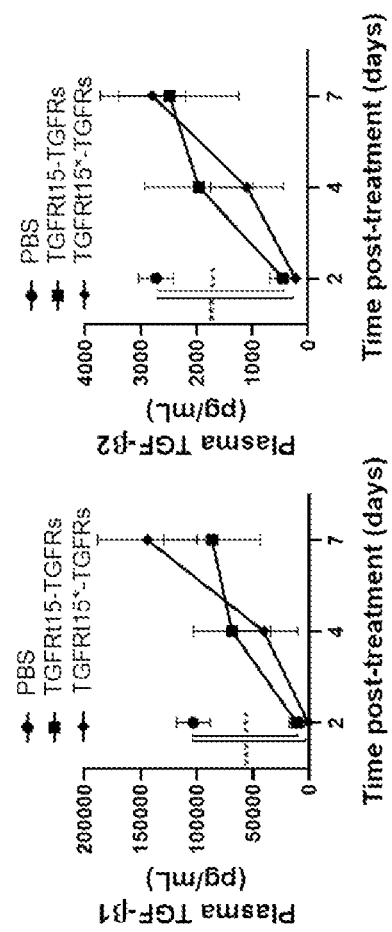

FIG. 249 shows plasma levels of TGF-β isoforms in mice after in vivo treatment with PBS, TGFRt15-TGFRs (3 mg/kg) or TGFRt15*-TGFRs (3 mg/kg).

FIGS. 250A-B show the changes in rates of glycolytic capacity (ECAR) (FIG. 250A) and mitochondrial respiratory capacity (OCR) (FIG. 250B) in splenocytes of mice following in vivo treatment with PBS, TGFRt15-TGFRs, TGFRt15*-TGFRs or IL15SA.

Figures 251A, 251B:
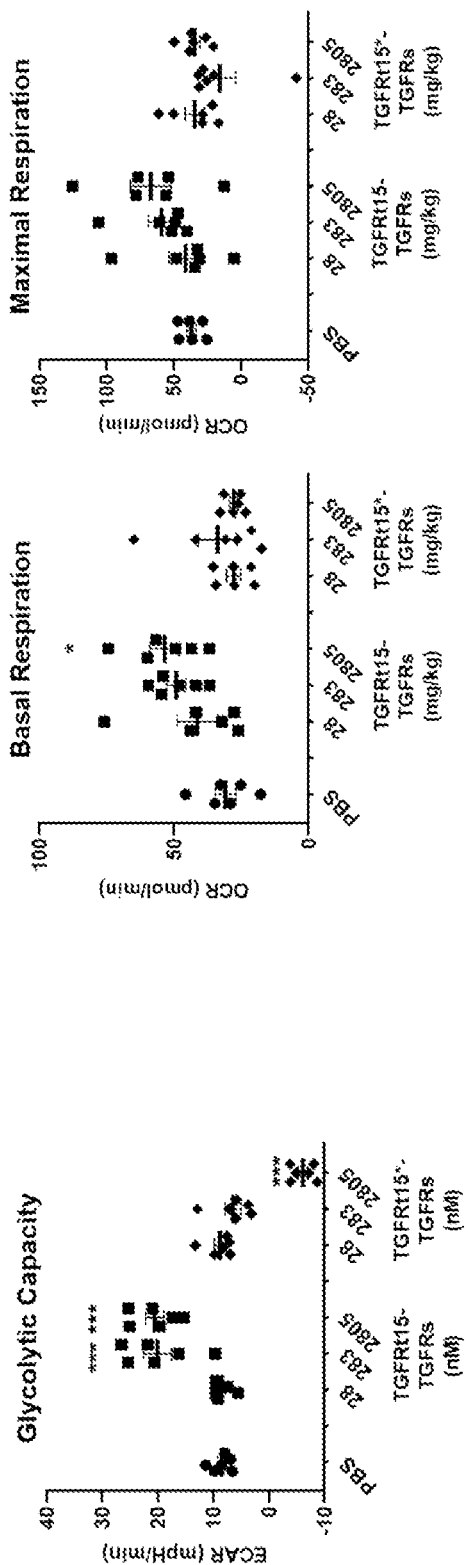

FIGS. 251A-B show the changes in rates of glycolytic capacity (ECAR) (FIG. 251A) and mitochondrial respiratory capacity (OCR) (FIG. 251B) in mouse splenocytes following in vitro treatment with PBS, TGFRt15-TGFRs, or TGFRt15*-TGFRs.

Figure 252B:
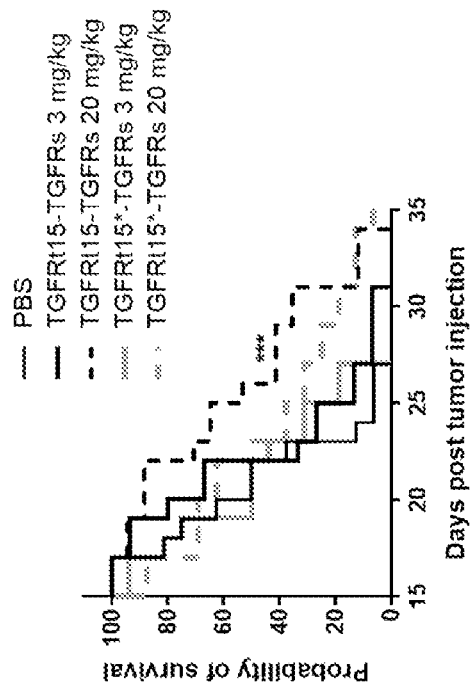
Figure 252A:
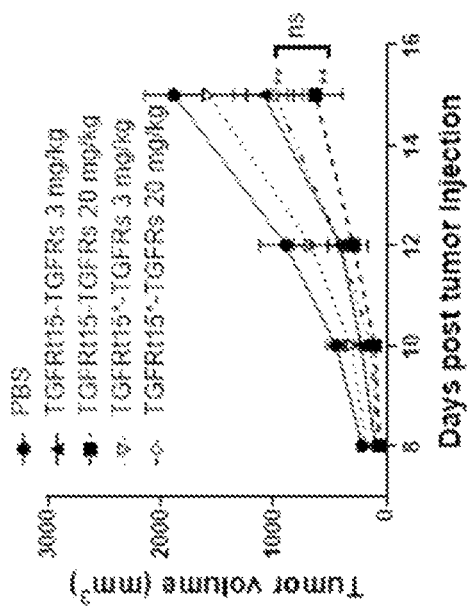
Figures 252C, 252D, 252E:
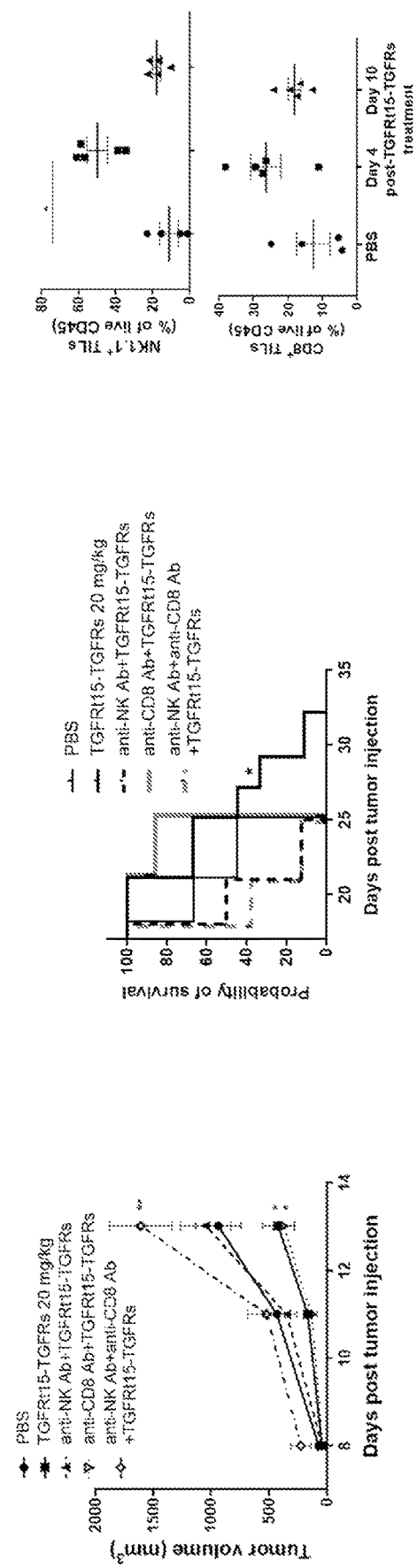

FIGS. 252A-E show the changes in tumor growth and survival of B16F10 melanoma tumors in C57BL/6 mice following in vitro treatment with PBS, TGFRt15-TGFRs, or TGFRt15*-TGFRs. Tumor volume (FIG. 252A) and mouse survival (based on tumor volume <4000 mm 3) (FIG. 252B) were assessed. Mice were intraperitoneally treated with anti-CD8, anti-NK, or anti-CD8 and anti-NK Abs for 1 week to deplete immune cells prior to injection with B16F10 melanoma tumor cells as in FIG. 252A. Tumor bearing mice were then treated with PBS or 20 mg/kg TGFRt15-TGFRs on day 1 and 4 post-tumor cell inoculation. Tumor volume of animals (FIG. 252C) and mouse survival (FIG. 252D) were assessed. B16F10 tumor bearing mice were treated with PBS or 20 mg/kg of TGFRt15-TGFRs on day 1 and 7 post-tumor inoculation (FIG. 252E). On day 11 post tumor inoculation, tumors were collected and tumor-infiltrating NK1.1$^+$ cells and CD8$^+$ T cells were quantitated by flow cytometry.

Figures 253A, 253B:
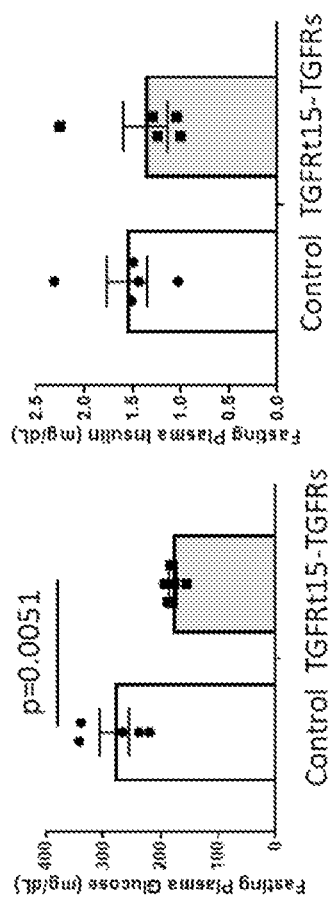

FIGS. 253A-B show treatment effects on fasting plasma glucose (FIG. 253A) and insulin (FIG. 253B) levels in db/db mice receiving PBS (control) or TGFRt15-TGFRs.

FIG. 254A shows the fold change in gene expression levels in pancreas of db/db mice receiving TGFRt15-TGFRs compared to PBS control.

FIGS. 254B-D show the average fold change in pancreatic expression levels for genes of the SASP, Aging and Beta cell indices, respectively, for db/db mice receiving TGFRt15-TGFRs compared to PBS control.

Figure 255A:
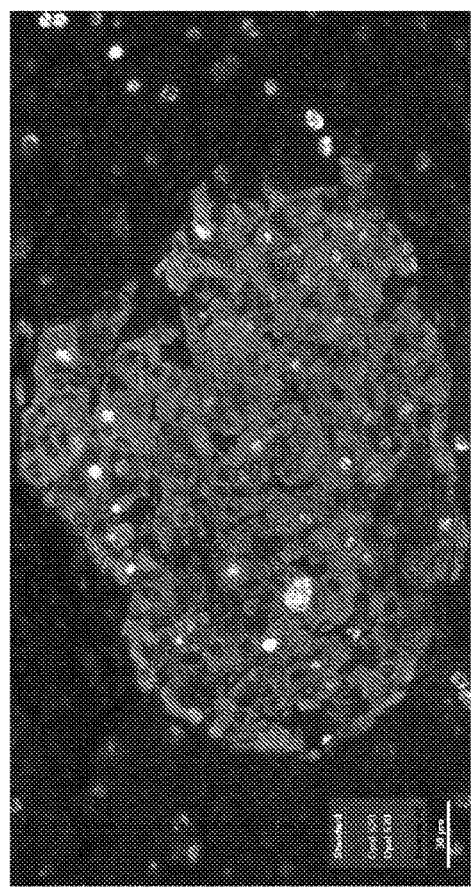
Figure 255B:
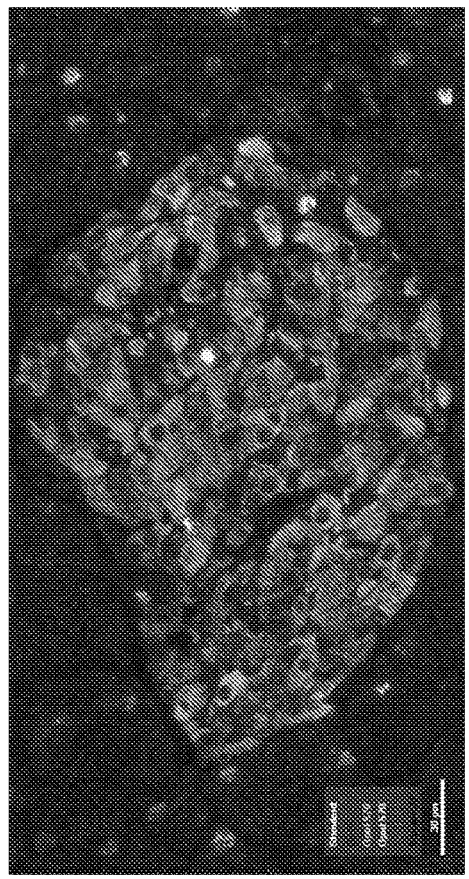
Figures 255C, 255D:
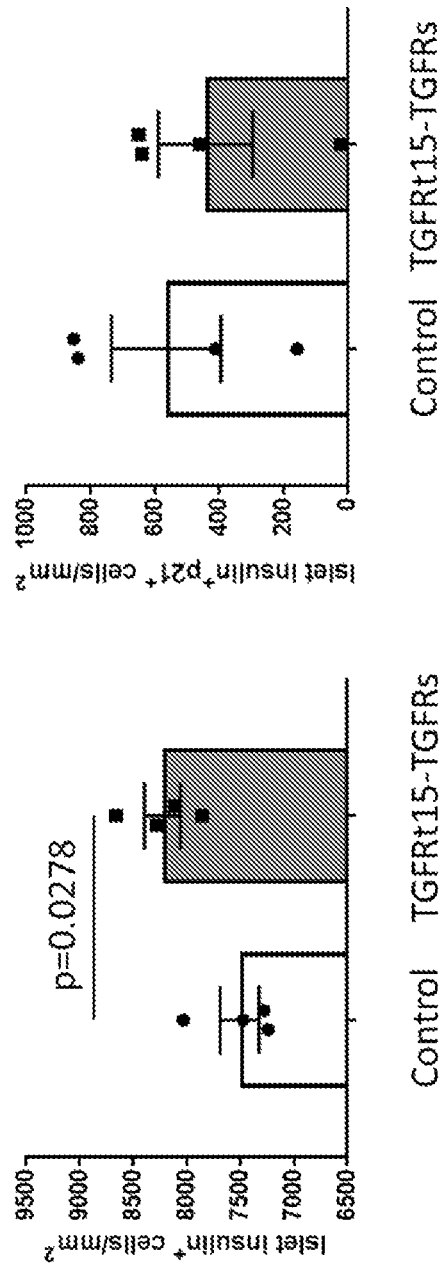

FIGS. 255A-B show multispectral imaging of pancreatic tissue sections from db/db mice treated with PBS (control) (FIG. 255A) or TGFRt15-TGFRs (FIG. 255B). A representative pancreatic islet is shown, insulin$^+$ islet beta cells as OPAL-520, insulin$^+$p21$^+$ beta cells as OPAL-570 (seen as white cells in gray-scale image) was reduced in TGRt15-TGFRs treated group (FIG. 255B) compared to PBS treated group (FIG. 255A). FIGS. 255C and 255D show levels of islet insulin+(FIG. 255C) and islet insulin$^+$ p21$^+$ (FIG. 255D) cells in pancreatic tissue sections from db/db mice treated with PBS (control) or TGFRt15-TGFRs.

Figures 256A, 256B, 256C:
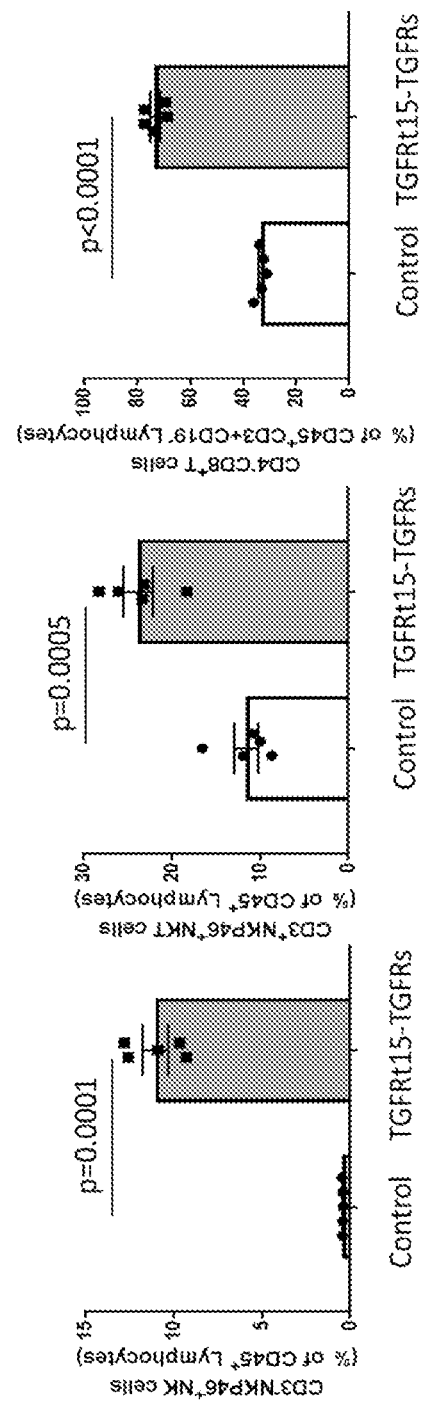

FIGS. 256A-C show treatment effects on the percentage of blood immune cell subsets in db/db mice receiving PBS (control) or TGFRt15-TGFRs.

Figure 257:
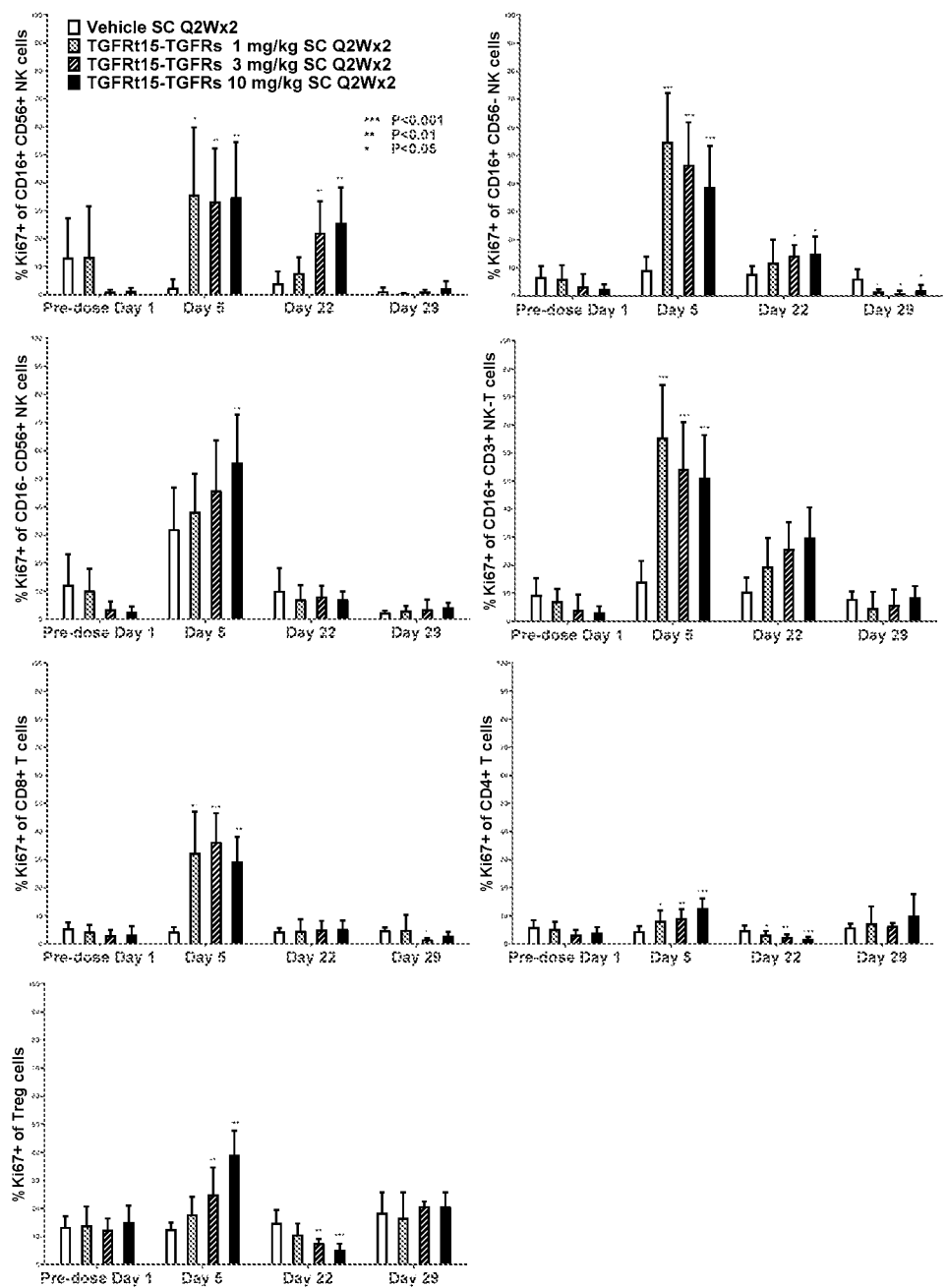

FIG. 257 shows the percentage of Ki67 positive immune cells induced in the blood following subcutaneous treatment of Cynomolgus monkeys with TGFRt15-TGFRs compared to PBS (vehicle).

Figure 258:
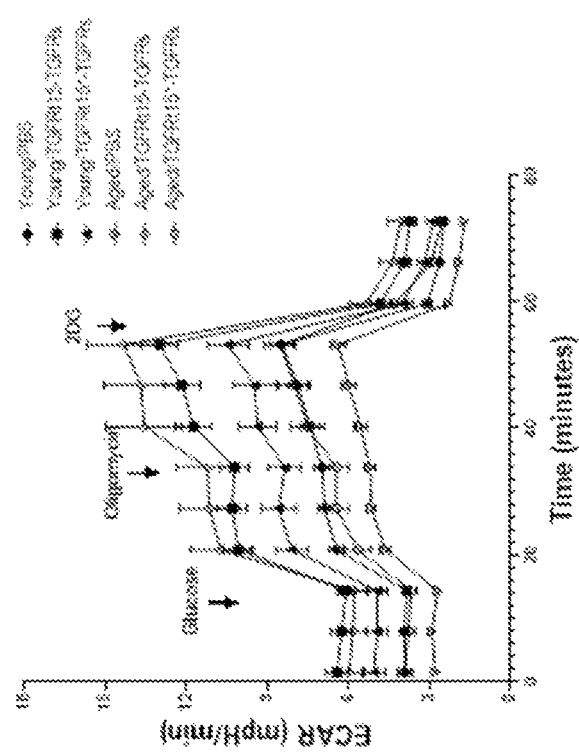

FIG. 258 shows the extracellular acidification rate (ECAR) representing glycolytic function of splenocytes isolated from young (6-week-old) and aged (72-week-old) mice 4 days after in vivo treatment with PBS, TGFRt15-TGFRs (3 mg/kg) or TGFRt15*-TGFRs (3 mg/kg).

Figure 259:
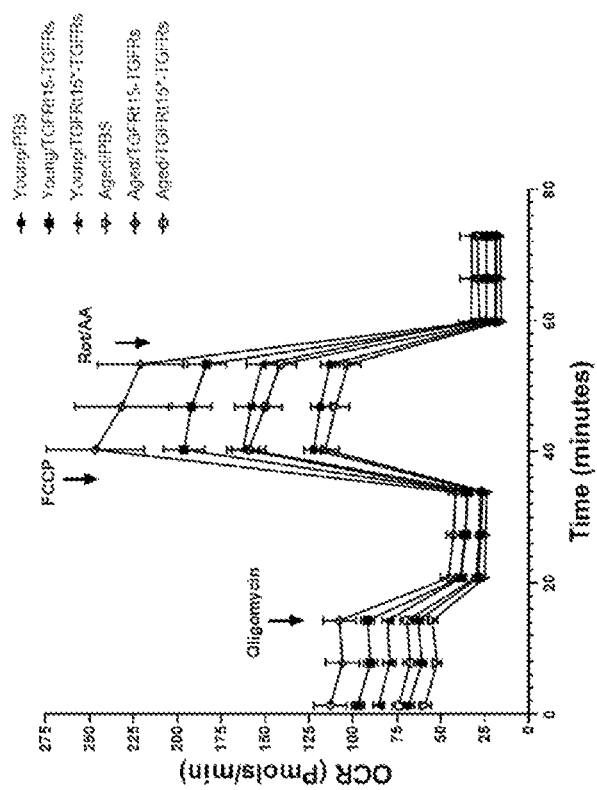

FIG. 259 shows the oxygen consumption rate (OCR) representing mitochondrial respiration of splenocytes isolated from young (6-week-old) and aged (72-week-old) mice 4 days after in vivo treatment with PBS, TGFRt15-TGFRs (3 mg/kg) or TGFRt15*-TGFRs (3 mg/kg).

Figure 260:
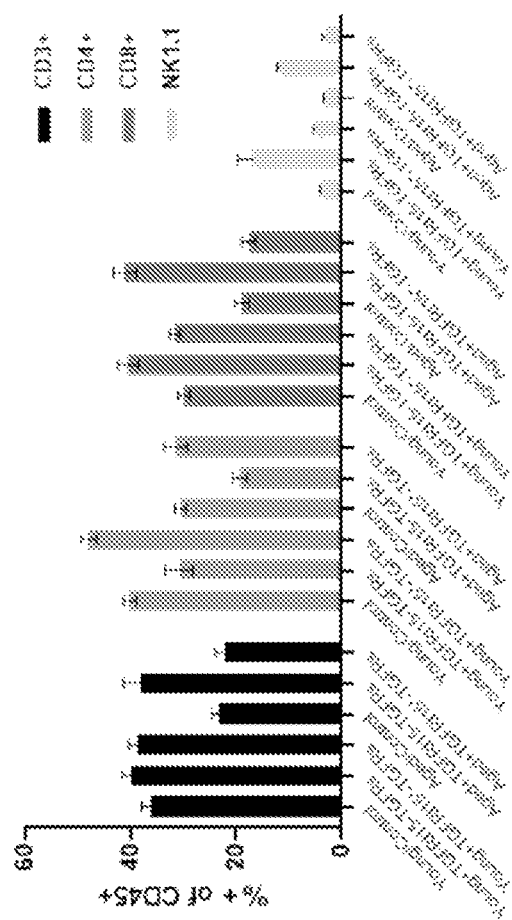

FIG. 260 shows the percentages of immune cell subsets in the blood of young (6-week-old) and aged (72-week-old) mice 4 days after in vivo treatment with PBS, TGFRt15-TGFRs (3 mg/kg) or TGFRt15*-TGFRs (3 mg/kg).

Figure 261:
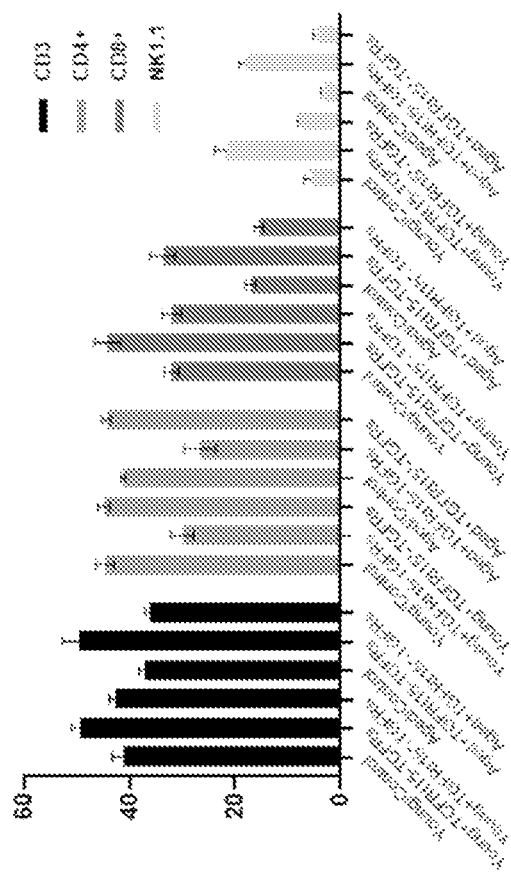

FIG. 261 shows the percentages of immune cell subsets in the spleen of young (6-week-old) and aged (72-week-old) mice 4 days after in vivo treatment with PBS, TGFRt15-TGFRs or TGFRt15*-TGFRs.

Figure 262:
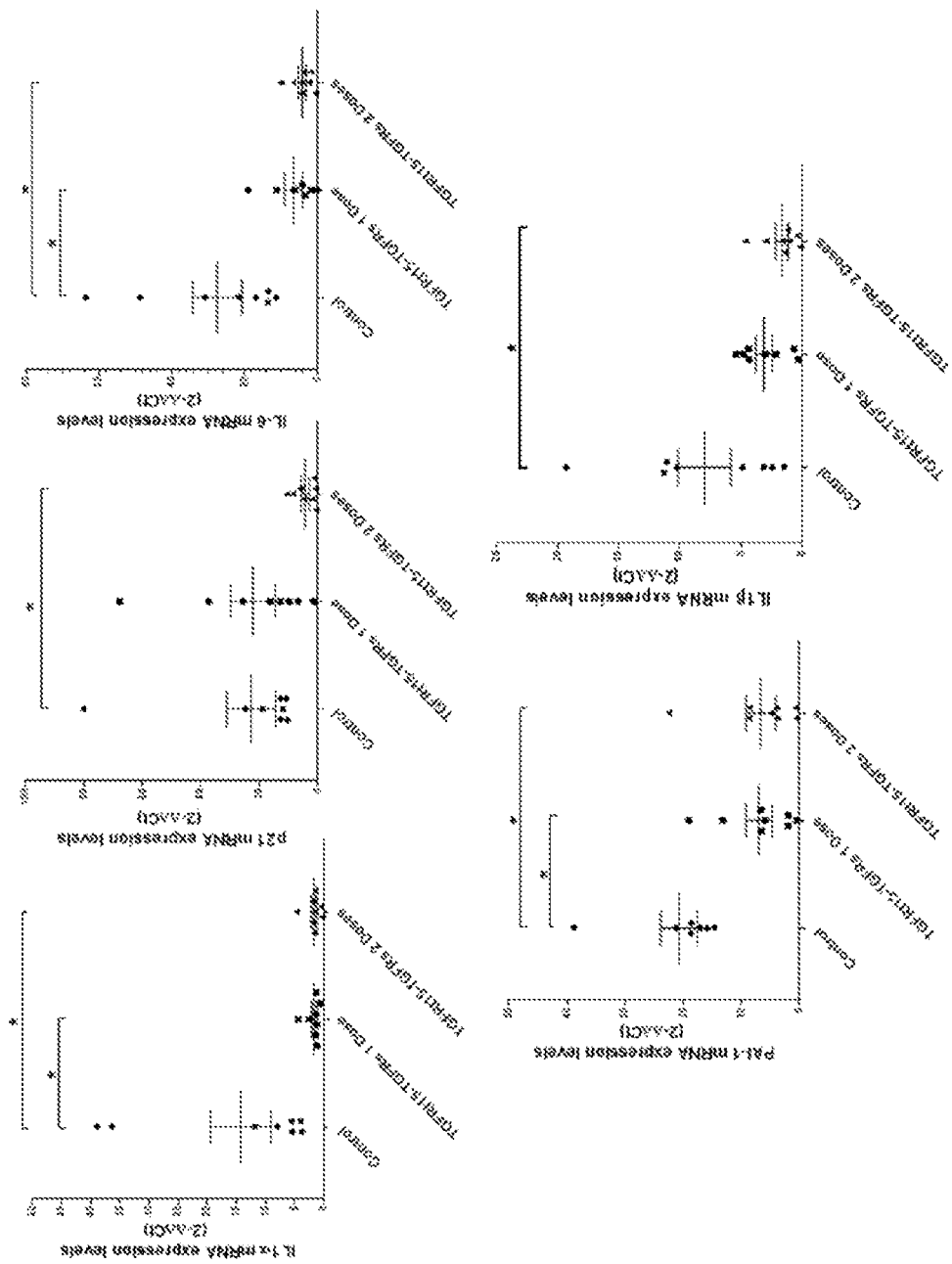

FIG. 262 shows gene expression levels for IL1-α, IL1-β, IL-6, p21 and PAI-1 in liver of aged mice after one or two doses of TGFRt15-TGFRs treatment.

Figure 263:
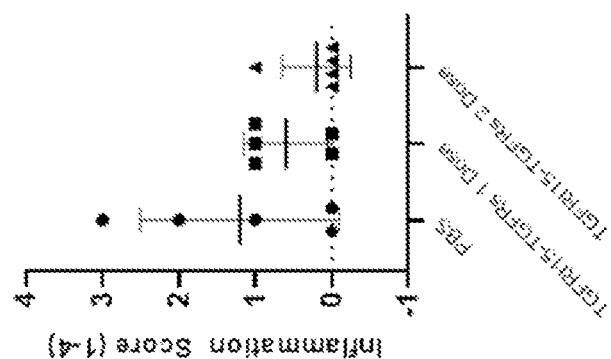

FIG. 263 shows the inflammation score of liver tissues of aged mice after one or two doses of TGFRt15-TGFRs treatment.

Figure 264:
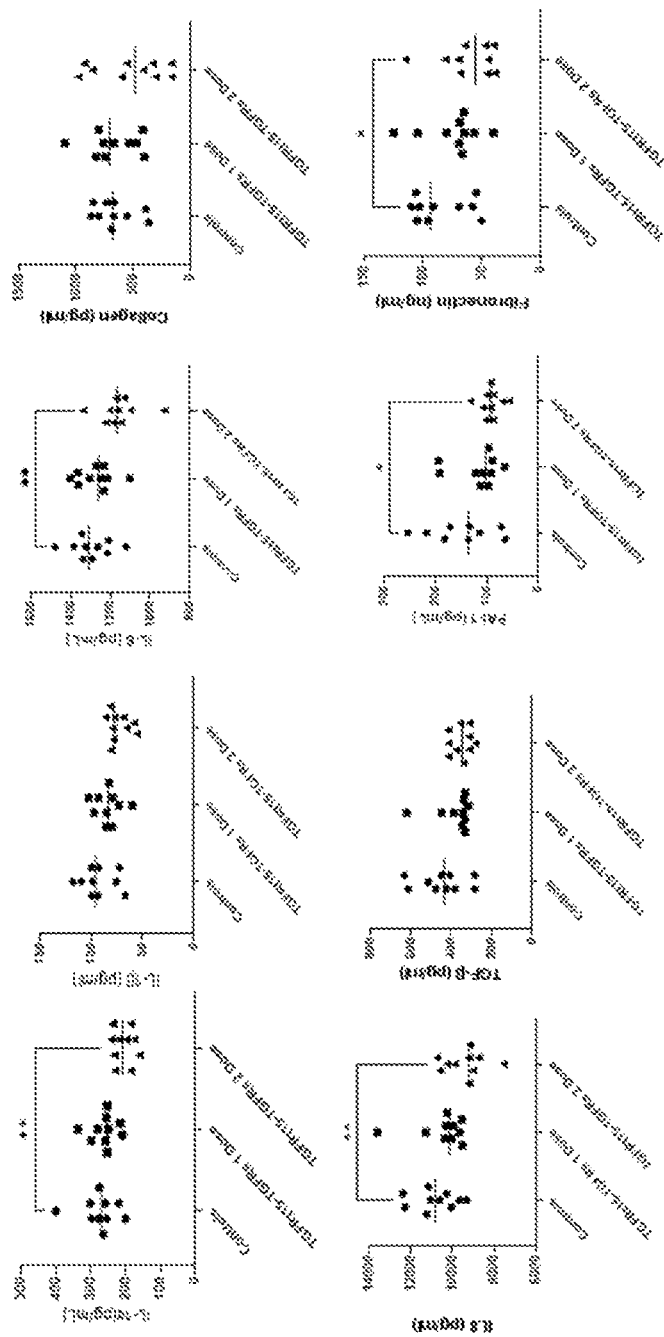

FIG. 264 shows expression levels of IL1-α, IL1-β, IL-6, IL-8, TGF-β, PAI-1, collagen and fibronectin protein in liver of aged mice after with one or two doses treatment of TGFRt15-TGFRs.

Figure 265:
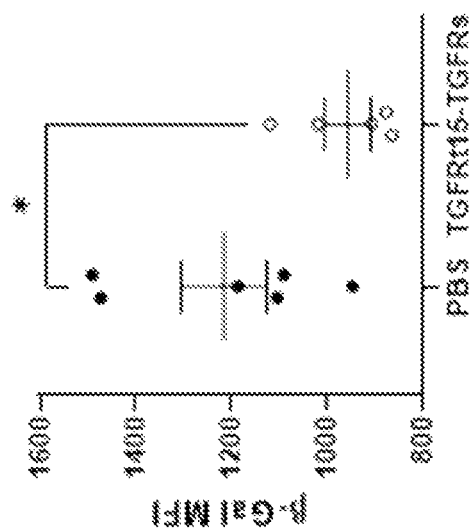

FIG. 265 shows the levels of β-galactosidase in liver tissues of aged mice 4 days after in vivo treatment with PBS or TGFRt15-TGFRs.

Figure 266:
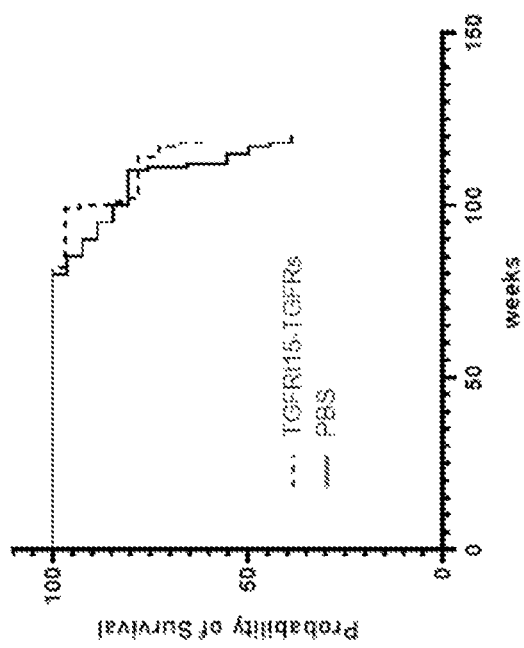

FIG. 266 shows the survival curves of 72-week-old C57BL/6 mice following subcutaneous treatment with PBS or one dose of TGFRt15-TGFRs (3 mg/kg).

Figure 267:
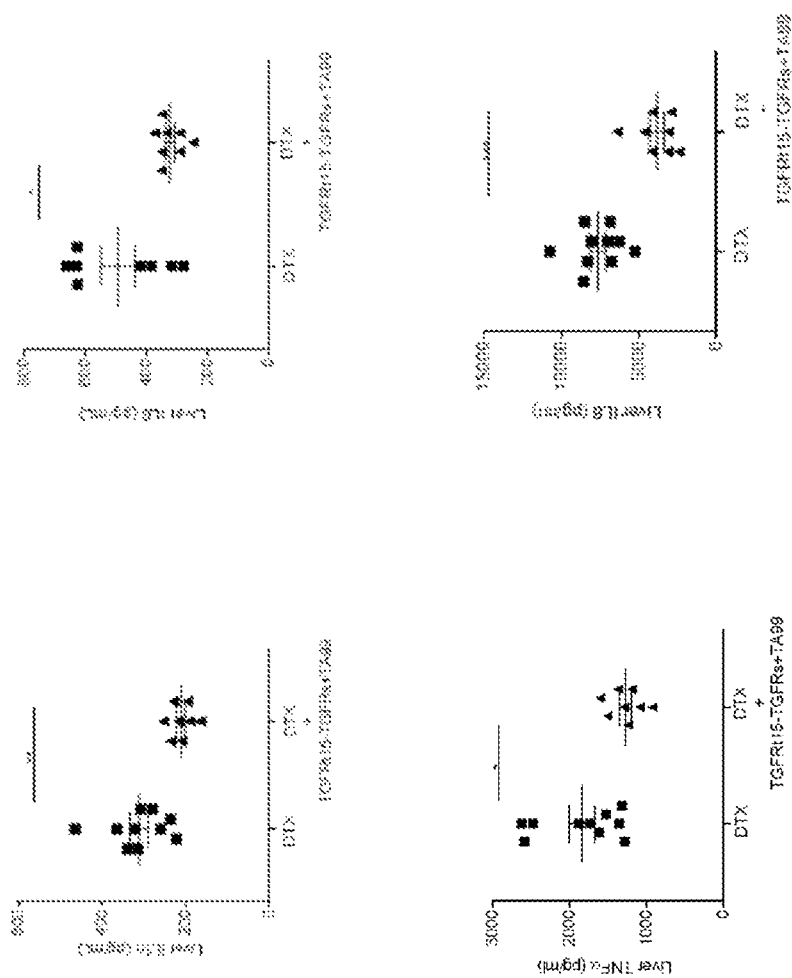

FIG. 267 shows protein levels of SASP factors in livers of B16F10 tumor-bearing mice following chemotherapy and TGFRt15-TGFRs+TA99 therapy.

Figures 268A, 268B:
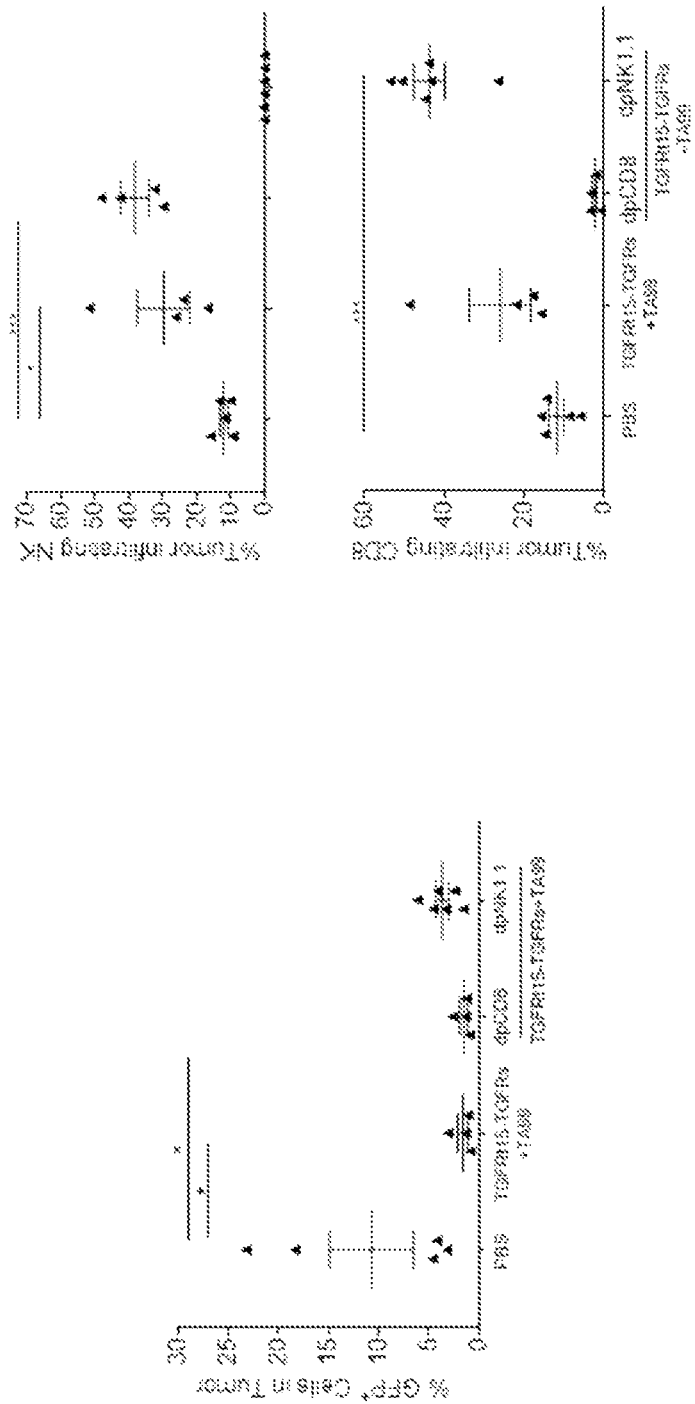

FIGS. 268A-B show effects of CD8$^+$ T cells (dpCD8) and NK cell (dpNK) antibody depletion on the levels of TIS B16F10-GFP cells (FIG. 268A) and NK and CD8$^+$ T cells (FIG. 268B) in the tumors of mice following chemotherapy and TGFRt15-TGFRs+TA99 therapy.

Figure 269A:
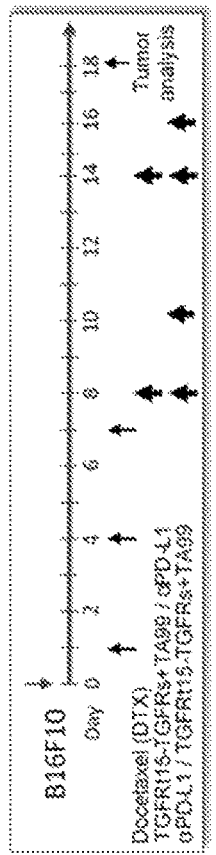
Figure 269B:
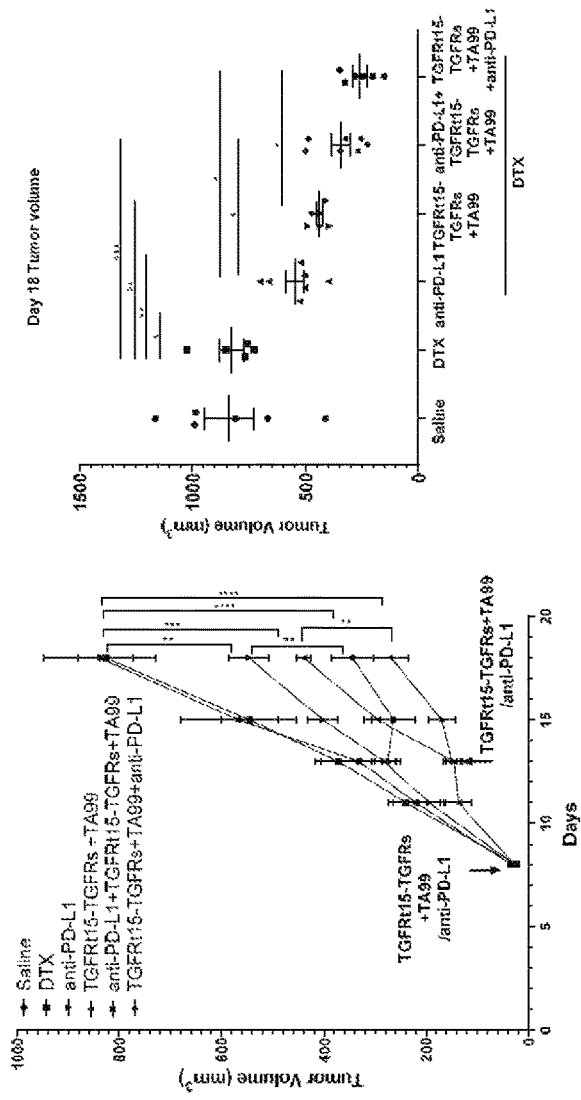
Figures 269C, 269D, 269E:
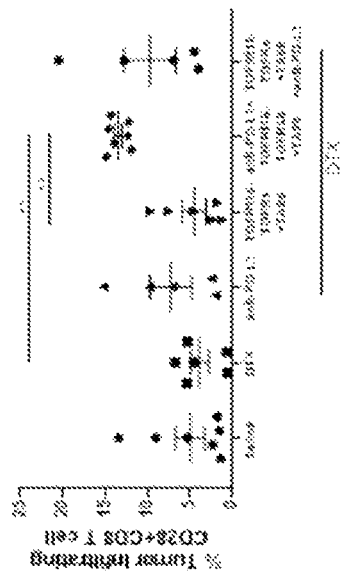

FIGS. 269A-E show the anti-tumor activity and mechanism of action of TGFRt15-TGFRs+TA99 in combination with immune checkpoint inhibitor in B16F10 tumor-bearing mice. FIG. 269A shows an exemplary schematic for treating B16F10 melanoma in a mouse model. FIG. 269B shows the change in tumor volume over time and at day 18 following combination treatments including TGFRt15-TGFRs+TA99+anti-PD-L1 antibody following doxetaxel as compared to PBS or chemotherapy treatment alone. FIGS. 269C and 269D show treatment effects on the percentages of tumor infiltrating CD28$^+$CD8$^+$ T cells and splenic IFNγ$^+$CD8$^+$ T cells on day 18. FIG. 269E shows treatment effects on the levels (MFI) of NKG2D of tumor infiltrating CD8$^+$ and CD8$^+$CD44$^{hi}$ T cells on day 18.

Figure 270A:
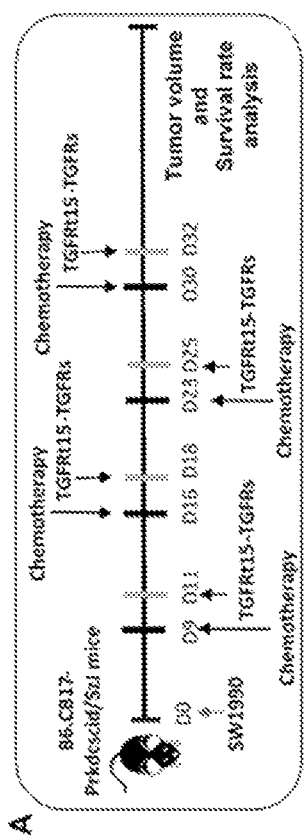
Figure 270B:
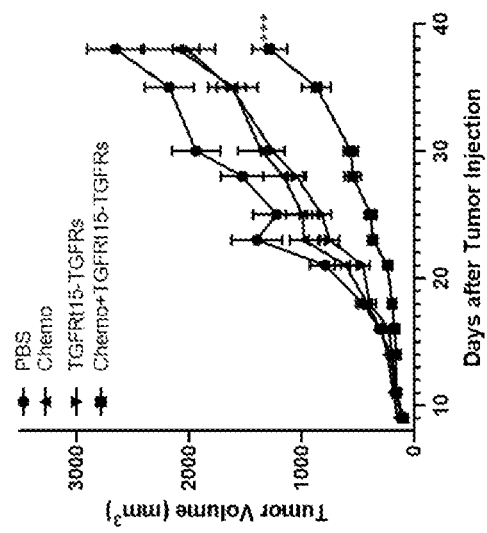
Figures 270C, 270D:
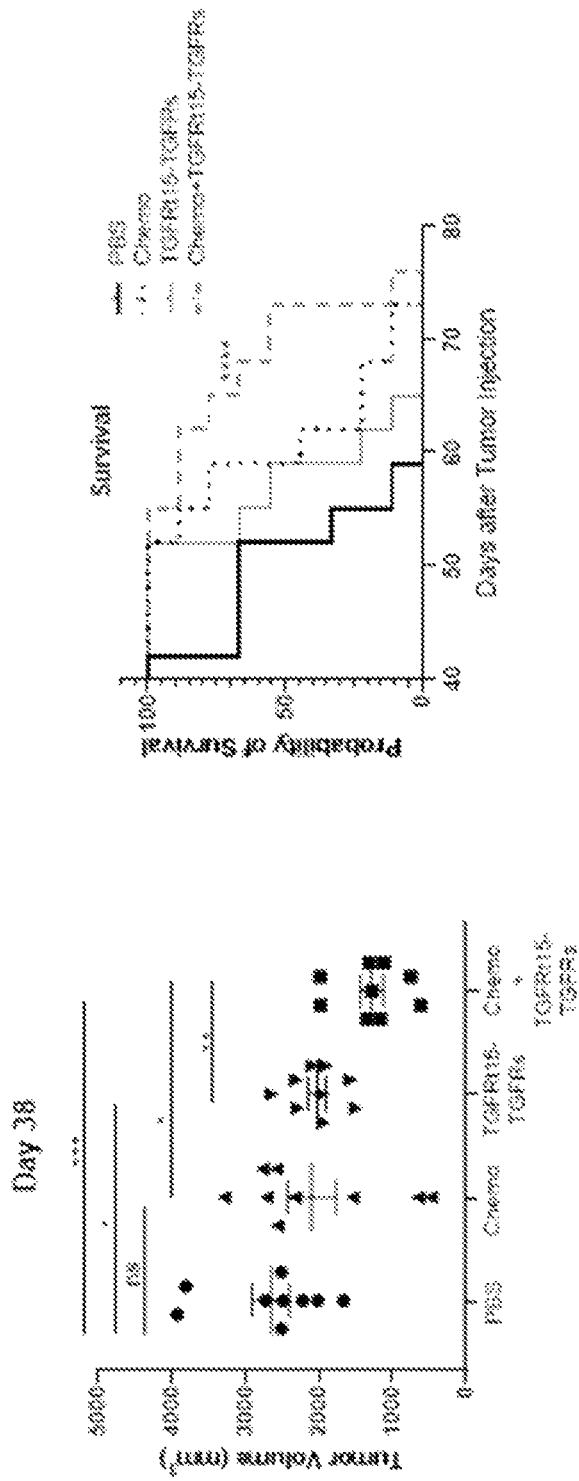

FIGS. 270A-D show the changes in tumor growth and survival of SW1990 human pancreatic tumors in C57BL/6 scid mice following in vitro treatment with PBS, gemcitabine and nab-paclitaxel chemotherapy, TGFRt15-TGFRs, or TGFRt15-TGFRs+chemotherapy. FIG. 270A shows an exemplary schematic for treating SW1990 human pancreatic tumors in a xenograft mouse model. FIGS. 270B and 270C show the change in tumor volume over time and at day 38, respectively, following combination treatments including TGFRt15-TGFRs+chemotherapy as compared to PBS or chemotherapy treatment alone. FIG. 270D shows treatment effects on survival of mice bearing SW1990 human pancreatic tumors.

DETAILED DESCRIPTION

Provided herein are methods of killing or reducing the number of naturally-occurring and/or treatment-induced senescent cells in a subject that include administering to the subject a therapeutically effective amount of one or more agent(s) that result(s) in a decrease in the activation of a TGF-β receptor. Also provided herein are methods of decreasing the accumulation of naturally-occurring and/or treatment-induced senescent cells in a subject that include administering to the subject a therapeutically effective amount of one or more agent(s) that result(s) in a decrease in the activation of a TGF-β receptor. Also provided herein are methods of decreasing a level of a marker of naturally-occurring and/or treatment-induced senescent cells in a subject that include administering to the subject a therapeutically effective amount of one or more agent(s) that result(s) in a decrease in the activation of a TGF-β receptor. Also provided herein are methods of reducing the activity of naturally-occurring and/or treatment-induced senescent cells in a subject that include administering to the subject a therapeutically effective amount of one or more agent(s) that result(s) in a decrease in the activation of a TGF-β receptor. Also provided herein are methods of decreasing levels or activity of SASP factors derived from naturally-occurring and/or treatment-induced senescent cells in a subject that include administering to the subject a therapeutically effective amount of one or more agent(s) that result(s) in a decrease in the activation of a TGF-β receptor.

Further provided herein are methods of killing or reducing the number of naturally-occurring and/or treatment-induced senescent cells in a subject that include administering to the subject a therapeutically effective amount of one or more common gamma-chain family cytokine receptor activating agent(s). Also provided herein are methods of decreasing the accumulation of naturally-occurring and/or treatment-induced senescent cells in a subject that include administering to the subject a therapeutically effective amount of one or more common gamma-chain family cytokine receptor activating agent(s). Also provided herein are methods of decreasing a level of a marker of naturally-occurring and/or treatment-induced senescent cells in a subject that include administering to the subject a therapeutically effective amount of one or more common gamma-chain family cytokine receptor activating agent(s). Also provided herein are methods of reducing the activity of naturally-occurring and/or treatment-induced senescent cells in a subject that include administering to the subject a therapeutically effective amount of one or more common gamma-chain family cytokine receptor activating agent(s). Also provided herein are methods of decreasing levels and/or activity of one or more SASP factor(s) derived from naturally-occurring and/or treatment-induced senescent cells in a subject that include administering to the subject a therapeutically effective amount of one or more common gamma-chain family cytokine receptor activating agent(s).

Provided herein are methods of treating an aging-related disease or condition in a subject in need thereof that include administering to a subject identified as having an aging-related disease or condition a therapeutically effective amount of one or more natural killer (NK) cell activating agent(s) and/or a therapeutically effective number of activated NK cells. Also provided herein are methods of killing or reducing the number of senescent cells in a subject in need thereof that include administering to the subject a therapeutically effective amount of one or more NK cell activating agent(s) and/or a therapeutically effective number of activated NK cells. Also provided herein are methods of improving the texture and/or appearance of skin and/or hair in a subject in need thereof over a period of time that include administering to the subject a therapeutically effective amount of one or more natural killer (NK) cell activating agent(s) and/or a therapeutically effective number of activated NK cells. Also provided herein are methods of assisting in the treatment of obesity in a subject in need thereof over a period of time that include administering to the subject a therapeutically effective amount of one or more natural killer (NK) cell activating agent(s) and/or a therapeutically effective number of activated NK cells.

Activated NK Cells

Some embodiments of any of the methods described herein can include administering to a subject (e.g., any of the exemplary subjects described herein) a therapeutically effective number of activated NK cells (e.g., human activated NK cells). An activated NK cell is an NK cell (e.g., a human NK cell) that has increased expression levels of two or more (e.g., three, four, five, or six) of CD25, CD69, MTOR-C1, SREBP1, IFN-γ, and a granzyme (e.g., granzyme B), e.g., as compared to a resting NK cell (e.g., a human resting NK cell). For example, an activated NK cell can have at least a 10% increase (e.g., at least a 15% increase, at least a 20% increase, at least a 25% increase, at least a 30% increase, at least a 35% increase, at least a 40% increase, at least a 45% increase, at least a 50% increase, at least a 55% increase, at least a 60% increase, at least a 65% increase, at least a 70% increase, at least a 75% increase, at least a 80% increase, at least a 85% increase, at least a 90% increase, at least a 95% increase, at least a 100% increase, at least a 120% increase, at least a 140% increase, at least a 160% increase, at least a 180% increase, at least a 200% increase, at least a 220% increase, at least a 240% increase, at least a 260% increase, at least a 280% increase, or at least a 300% increase) in the expression levels of two of more (e.g., three, four, five, or six) of CD25, CD69, MTOR-C1, SREBP1, IFN-γ, and a granzyme (e.g., granzyme B), e.g., as compared to a resting NK cell (e.g., a human activated NK cell).

In some embodiments, an activated NK cell can optionally further have at least a 10% increase (e.g., at least a 15% increase, at least a 20% increase, at least a 25% increase, at least a 30% increase, at least a 35% increase, at least a 40% increase, at least a 45% increase, at least a 50% increase, at least a 55% increase, at least a 60% increase, at least a 65% increase, at least a 70% increase, at least a 75% increase, at least a 80% increase, at least a 85% increase, at least a 90% increase, at least a 95% increase, at least a 100% increase, at least a 120% increase, at least a 140% increase, at least a 160% increase, at least a 180% increase, at least a 200% increase, at least a 220% increase, at least a 240% increase, at least a 260% increase, at least a 280% increase, or at least a 300% increase) in the expression levels of two or more (e.g., 3, 4, 5, 6, 7, 8, 9, 10, 11, 12, 13, 14, 15, 16, 17, 18, 19, 20, 21, 22, 23, 24, 25, 26, 27, 28, or 29) of CD25, CD59, CD352, NKp80, DNAM-1, 2B4, NKp30, NKp44, NKp46, NKG2D, CD16, KIR2DS1, KIR2Ds2/3, KIR2DL4, KIR2DS4, KIR2DS5, KIR3DS1, NKG2C, CCR7, CXCR3, L-Selectin, CXCR1, CXCR2, CX3CR1, ChemR23, CXCR4, CCR5, S1P5, c-Kit, mTORC1, e.g., as compared to a resting NK cell (e.g., a human activated NK cell).

For example, an activated NK cell (e.g., a human activated NK cell) can have about a 10% increase to about a 500% increase, about a 10% increase to about a 450% increase, about a 10% increase to about a 400% increase, about a 10% increase to about a 350% increase, about a 10% increase to about a 300% increase, about a 10% increase to about a 280% increase, about a 10% increase to about a 260% increase, about a 10% increase to about a 240% increase, about a 10% increase to about a 220% increase, about a 10% increase to about a 200% increase, about a 10% increase to about a 180% increase, about a 10% increase to about a 160% increase, about a 10% increase to about a 140% increase, about a 10% increase to about a 120% increase, about a 10% increase to about a 100% increase, about a 10% increase to about a 80% increase, about a 10% increase to about a 60% increase, about a 10% increase to about a 40% increase, about a 10% increase to about a 20% increase, a 20% increase to about a 500% increase, about a 20% increase to about a 450% increase, about a 20% increase to about a 400% increase, about a 20% increase to about a 350% increase, about a 20% increase to about a 300% increase, about a 20% increase to about a 280% increase, about a 20% increase to about a 260% increase, about a 20% increase to about a 240% increase, about a 20% increase to about a 220% increase, about a 20% increase to about a 200% increase, about a 20% increase to about a 180% increase, about a 20% increase to about a 160% increase, about a 20% increase to about a 140% increase, about a 20% increase to about a 120% increase, about a 20% increase to about a 100% increase, about a 20% increase to about a 80% increase, about a 20% increase to about a 60% increase, about a 20% increase to about a 40% increase, a 40% increase to about a 500% increase, about a 40% increase to about a 450% increase, about a 40% increase to about a 400% increase, about a 40% increase to about a 350% increase, about a 40% increase to about a 300% increase, about a 40% increase to about a 280% increase, about a 40% increase to about a 260% increase, about a 40% increase to about a 240% increase, about a 40% increase to about a 220% increase, about a 40% increase to about a 200% increase, about a 40% increase to about a 180% increase, about a 40% increase to about a 160% increase, about a 40% increase to about a 140% increase, about a 40% increase to about a 120% increase, about a 40% increase to about a 100% increase, about a 40% increase to about a 80% increase, about a 40% increase to about a 60% increase, a 60% increase to about a 500% increase, about a 60% increase to about a 450% increase, about a 60% increase to about a 400% increase, about a 60% increase to about a 350% increase, about a 60% increase to about a 300% increase, about a 60% increase to about a 280% increase, about a 60% increase to about a 260% increase, about a 60% increase to about a 240% increase, about a 60% increase to about a 220% increase, about a 60% increase to about a 200% increase, about a 60% increase to about a 180% increase, about a 60% increase to about a 160% increase, about a 60% increase to about a 140% increase, about a 60% increase to about a 120% increase, about a 60% increase to about a 100% increase, about a 60% increase to about a 80% increase, a 80% increase to about a 500% increase, about a 80% increase to about a 450% increase, about a 80% increase to about a 400% increase, about a 80% increase to about a 350% increase, about a 80% increase to about a 300% increase, about a 80% increase to about a 280% increase, about a 80% increase to about a 260% increase, about a 80% increase to about a 240% increase, about a 80% increase to about a 220% increase, about a 80% increase to about a 200% increase, about a 80% increase to about a 180% increase, about a 80% increase to about a 160% increase, about a 80% increase to about a 140% increase, about a 80% increase to about a 120% increase, about a 80% increase to about a 100% increase, a 100% increase to about a 500% increase, about a 100% increase to about a 450% increase, about a 100% increase to about a 400% increase, about a 100% increase to about a 350% increase, about a 100% increase to about a 300% increase, about a 100% increase to about a 280% increase, about a 100% increase to about a 260% increase, about a 100% increase to about a 240% increase, about a 100% increase to about a 220% increase, about a 100% increase to about a 200% increase, about a 100% increase to about a 180% increase, about a 100% increase to about a 160% increase, about a 100% increase to about a 140% increase, about a 100% increase to about a 120% increase, a 120% increase to about a 500% increase, about a 120% increase to about a 450% increase, about a 120% increase to about a 400% increase, about a 120% increase to about a 350% increase, about a 120% increase to about a 300% increase, about a 120% increase to about a 280% increase, about a 120% increase to about a 260% increase, about a 120% increase to about a 240% increase, about a 120% increase to about a 220% increase, about a 120% increase to about a 200% increase, about a 120% increase to about a 180% increase, about a 120% increase to about a 160% increase, about a 120% increase to about a 140% increase, a 140% increase to about a 500% increase, about a 140% increase to about a 450% increase, about a 140% increase to about a 400% increase, about a 140% increase to about a 350% increase, about a 140% increase to about a 300% increase, about a 140% increase to about a 280% increase, about a 140% increase to about a 260% increase, about a 140% increase to about a 240% increase, about a 140% increase to about a 220% increase, about a 140% increase to about a 200% increase, about a 140% increase to about a 180% increase, about a 140% increase to about a 160% increase, a 160% increase to about a 500% increase, about a 160% increase to about a 450% increase, about a 160% increase to about a 400% increase, about a 160% increase to about a 350% increase, about a 160% increase to about a 300% increase, about a 160% increase to about a 280% increase, about a 160% increase to about a 260% increase, about a 160% increase to about a 240% increase, about a 160% increase to about a 220% increase, about a 160% increase to about a 200% increase, about a 160% increase to about a 180% increase, a 180% increase to about a 500% increase, about a 180% increase to about a 450% increase, about a 180% increase to about a 400% increase, about a 180% increase to about a 350% increase, about a 180% increase to about a 300% increase, about a 180% increase to about a 280% increase, about a 180% increase to about a 260% increase, about a 180% increase to about a 240% increase, about a 180% increase to about a 220% increase, about a 180% increase to about a 200% increase, a 200% increase to about a 500% increase, about a 200% increase to about a 450% increase, about a 200% increase to about a 400% increase, about a 200% increase to about a 350% increase, about a 200% increase to about a 300% increase, about a 200% increase to about a 280% increase, about a 200% increase to about a 260% increase, about a 200% increase to about a 240% increase, about a 200% increase to about a 220% increase, a 220% increase to about a 500% increase, about a 220% increase to about a 450% increase, about a 220% increase to about a 400% increase, about a 220% increase to about a 350% increase, about a 220% increase to about a 300% increase, about a 220% increase to about a 280% increase, about a 220% increase to about a 260% increase, about a 220% increase to about a 240% increase, a 240% increase to about a 500% increase, about a 240% increase to about a 450% increase, about a 240% increase to about a 400% increase, about a 240% increase to about a 350% increase, about a 240% increase to about a 300% increase, about a 240% increase to about a 280% increase, about a 240% increase to about a 260% increase, a 260% increase to about a 500% increase, about a 260% increase to about a 450% increase, about a 260% increase to about a 400% increase, about a 260% increase to about a 350% increase, about a 260% increase to about a 300% increase, about a 260% increase to about a 280% increase, a 280% increase to about a 500% increase, about a 280% increase to about a 450% increase, about a 280% increase to about a 400% increase, about a 280% increase to about a 350% increase, about a 280% increase to about a 300% increase, a 300% increase to about a 500% increase, about a 300% increase to about a 450% increase, about a 300% increase to about a 400% increase, about a 300% increase to about a 350% increase, a 350% increase to about a 500% increase, about a 350% increase to about a 450% increase, about a 350% increase to about a 400% increase, a 400% increase to about a 500% increase, about a 400% increase to about a 450% increase, or a 400% increase to about a 500% increase, in the expression levels of two of more (e.g., three, four, five, or six) of CD25, CD69, mTORC1, SREBP1, IFN-γ, and a granzyme (e.g., granzyme B), e.g., as compared to a resting NK cell (e.g., a human resting NK cell).

In some embodiments, an activated NK cell can further have about a 10% increase to about a 500% increase (e.g., or any of the subranges of this range described herein) in the expression levels of two of more (e.g., 3, 4, 5, 6, 7, 8, 9, 10, 11, 12, 13, 14, 15, 16, 17, 18, 19, 20, 21, 22, 23, 24, 25, 26, 27, 28, or 29) of CD25, CD59, CD352, NKp80, DNAM-1, 2B4, NKp30, NKp44, NKp46, NKG2D, CD16, KIR2DS1, KIR2Ds2/3, KIR2DL4, KIR2DS4, KIR2DS5, KIR3DS1, NKG2C, CCR7, CXCR3, L-Selectin, CXCR1, CXCR2, CX3CR1, ChemR23, CXCR4, CCR5, S1P5, c-Kit, mTORC1, e.g., as compared to a resting NK cell (e.g., a human activated NK cell).

Non-limiting examples of assays that can be used to determine the expression level of CD25, CD69, CD59, CD352, NKp80, DNAM-1, 2B4, NKp30, NKp44, NKp46, NKG2D, CD16, KIR2DS1, KIR2Ds2/3, KIR2DL4, KIR2DS4, KIR2DS5, KIR3DS1, NKG2C, CCR7, CXCR3, L-Selectin, CXCR1, CXCR2, CX3CR1, ChemR23, CXCR4, CCR5, S1P5, c-Kit, mTORC1, MYC, SREBP1, IFN-γ, and a granzyme (e.g., granzyme B) include, e.g., immunoblotting, fluorescence-assisted cell sorting, enzyme-linked immunosorbent assays, and RT-PCR.

Non-limiting examples of commercial ELISA assays that can be used to determine the expression level of CD25 are available from Diaclone, Covalab Biotechnology, and Caltag Medsystems. The protein and cDNA sequences for mature human CD25 are shown below.

```
Mature Human CD25 Protein
                                   (SEQ ID NO: 1)
elcdddppe iphatfkama ykegtmlncc ckrgfrriks gslymlctgn sshsswdnqc qctssatrnt tkqvtpqpee qkerkttemq spmqpvdqas lpghcreppp weneateriy hfvvgqmvyy qcvqgyralh rgpaesvckm thgktrwtqp qlictgemet sqfpgeekpq aspegrpese tsclvtttdf qiqtemaatm etsiftteyq vavagcvfll isvlllsglt wqrrqrksrr ti Human CD25 cDNA
                                   (SEQ ID NO: 2)
gagctctg tgacgatgac ccgccagaga tcccacacgc cacattcaaa gccatggcct acaaggaagg aaccatgttg aactgtgaat gcaagagagg tttccgcaga ataaaaagcg ggtcactcta tatgctctgt acaggaaact ctagccactc gtcctgggac aaccaatgtc aatgcacaag ctctgccact cggaacacaa cgaaacaagt gacacctcaa cctgaagaac agaaagaaag gaaaaccaca gaaatgcaaa gtccaatgca gccagtggac caagcgagcc ttccaggtca ctgcagggaa cctccaccat gggaaaatga agccacagag agaatttatc atttcgtggt ggggcagatg gtttattatc agtgcgtcca gggatacagg gctctacaca gaggtcctgc tgagagcgtc tgcaaaatga cccacgggaa gacaaggtgg acccagcccc agctcatatg cacaggtgaa atggagacca gtcagtttcc aggtgaagag aagcctcagg caagccccga aggccgtcct gagagtgaga cttcctgcct cgtcacaaca acagattttc aaatacagac agaaatggct gcaaccatgg agacgtccat atttacaaca gagtaccagg tagcagtggc cggctgtgtt ttcctgctga tcagcgtcct cctcctgagt gggctcacct ggcagcggag acagaggaag agtagaagaa caatc
```

Non-limiting examples of commercial ELISA assays that can be used to determine the expression level of CD69 are available from RayBiotech, Novus Biologicals, and Aviscera Bioscience. The protein and cDNA sequences for mature human CD69 are shown below.

```
Mature Human CD69 Protein
                                   (SEQ ID NO: 3)
mssencfvae nsslhpesgq endatsphfs trhegsfqvp vlcavmnvvf itiliialia lsvgqyncpg qytfsmpsds hvsscsedwv gyqrkcyfis tvkrswtsaq nacsehgatl avidsekdmn flkryagree hwvglkkepg hpwkwsngke fnnwfnvtgs dkcvflknte vssmeceknl ywicnkpyk Human CD69 cDNA
                                   (SEQ ID NO: 4)
atgagctctg aaaattgttt cgtagcagag aacagctctt tgcatccgga gagtggacaa gaaaatgatg ccaccagtcc
```

```
ccatttctca acacgtcatg aagggtcctt ccaagttcct
gtcctgtgtg ctgtaatgaa tgtggtcttc atcaccattt
taatcatagc tctcattgcc ttatcagtgg ccaatacaa
ttgtccaggc caatacacat tctcaatgcc atcagacagc
catgtttctt catgctctga ggactgggtt ggctaccaga
ggaaatgcta ctttatttct actgtgaaga ggagctggac
ttcagcccaa aatgcttgtt ctgaacatgg tgctactctt
gctgtcattg attctgaaaa ggacatgaac tttctaaaac
gatacgcagg tagagaggaa cactgggttg gactgaaaaa
ggaacctggt cacccatgga agtggtcaaa tggcaaagaa
tttaacaact ggttcaacgt tacagggtct gacaagtgtg
tttttctgaa aaacacagag gtcagcagca tggaatgtga
gaagaattta tactggatat gtaacaaacc ttacaaataa
```

The protein and cDNA sequences for mature human CD59 are shown below.

```
Mature Human CD59 Protein
                                    (SEQ ID NO: 5)
lqcyncpnptadckt avncssdfda clitkaglqv ynkcwkfehc
nfndvttrlr eneltyycck kdlcnfneql en Human CD59 cDNA
                                    (SEQ ID NO: 6)
atgggaatcc aaggagggtc tgtcctgttc gggctgctgc
tcgtcctggc tgtcttctgc cattcaggtc atagcctgca
gtgctacaac tgtcctaacc caactgctga ctgcaaaaca
gccgtcaatt gttcatctga ttttgatgcg tgtctcatta
ccaaagctgg gttacaagtg tataacaagt gttggaagtt
tgagcattgc aatttcaacg acgtcacaac ccgcttgagg
gaaaatgagc taacgtacta ctgctgcaag aaggacctgt
gtaactttaa cgaacagctt gaaaatgtg ggacatcctt
atcagagaaa acagttcttc tgctggtgac tccatttctg
gcagcagcct ggagccttca tccctaa
```

The protein and cDNA sequences for mature human CD352 are shown below.

```
Mature Human CD352 Protein
                                    (SEQ ID NO: 7)
qssltplmv ngilgesvtl plefpagekv nfitwlfnet
slafivphet kspeihvtnp kqgkrlnftq syslqlsnlk
medtgsyraq istktsakls sytlrilrql rniqvtnhsq
lfqnmtcelh ltcsvedadd nvsfrwealg ntlssqpnlt
vswdprisse qdytciaena vsnlsfsvsa qklcedvkiq
ytdtkmilfm vsgicivfgf iillllvlrk rrdslslstq
rtqgpaesar nleyvsvspt nntvyasvth snreteiwtp
rendtitiys tinhskeskp tfsrataldn vv
```

```
Human CD352 cDNA
                                    (SEQ ID NO: 8)
atgttgtggc tgttccaatc gctcctgttt gtcttctgct
ttggcccagg gaatgtagtt tcacaaagca gcttaacccc
attgatggtg aacgggattc tggggagtc agtaactctt
ccctggagt ttcctgcagg agagaaggtc aacttcatca
cttggctttt caatgaaaca tctcttgcct tcatagtacc
ccatgaaacc aaaagtccag aaatccacgt gactaatccg
aaacaggaa agcgactgaa cttcacccag tcctactccc
tgcaactcag caacctgaag atggaagaca caggctctta
cagagcccag atatccacaa agacctctgc aaagctgtcc
agttacactc tgaggatatt aagacaactg aggaacatac
aagttaccaa tcacagtcag ctatttcaga atatgacctg
tgagctccat ctgacttgct ctgtggagga tgcagatgac
aatgtctcat tcagatggga ggccttggga aacacacttt
caagtcagcc aaacctcact gtctcctggg accccaggat
ttccagtgaa caggactaca cctgcatagc agagaatgct
gtcagtaatt tatccttctc tgtctctgcc agaagctttt
gcgaagatgt taaaattcaa tatacagata ccaaaatgat
tctgtttatg gtttctggga tatgcatagt cttcggtttc
atcatactgc tgttacttgt tttgaggaaa agaagagatt
ccctatcttt gtctactcag cgaacacagg gccccgagtc
cgcaaggaac ctagagtatg tttcagtgtc tccaacgaac
aacactgtgt atgcttcagt cactcattca aacagggaaa
cagaaatctg gacacctaga gaaatgata ctatcacaat
ttactccaca attaatcatt ccaaagagag taaacccact
ttttccaggg caactgccct tgacaatgtc gtgtaa
```

The protein and cDNA sequences for mature human NKp80 are shown below.

```
Mature Human NKp80 Protein
                                    (SEQ ID NO: 9)
mqdeerymtl nvqskkrssa qtsqltfkdy svtlhwykil
lgisgtvngi ltltlislil lvsqgvllkc qkgscsnatq
yedtgdlkvn ngtrrnisnk dlcasrsadq tvlcqsewlk
yqgkcywfsn emkswsdsyv yclerkshll iihdqlemaf
iqknlrqlny vwiglnftsl kmtwtwvdgs pidskiffik
gpakenscaa ikeskifset cssvfkwicq y
```

```
Human NKp80 cDNA
                                    (SEQ ID NO: 10)
atgcaagatg aagaaagata catgacattg aatgtacagt
caaagaaaag gagttctgcc caaacatctc aacttacatt
taaagattat tcagtgacgt tgcactggta taaaatctta
ctgggaatat ctggaaccgt gaatggtatt ctcactttga
```

-continued

```
ctttgatctc cttgatcctg ttggtactat gccaatcaga atggctcaaa taccaaggga agtgttattg gttctctaat gagatgaaaa gctggagtga cagttatgtg tattgtttgg aaagaaaatc tcatctacta atcatacatg accaacttga aatggctttt atacagaaaa acctaagaca attaaactac gtatggattg ggcttaactt tacctccttg aaaatgacat ggacttgggt ggatggttct ccaatagatt caaagatatt cttcataaag ggaccagcta aagaaaacag ctgtgctgcc attaaggaaa gcaaaatttt ctctgaaacc tgcagcagtg ttttcaaatg gatttgtcag tattag
```

The protein and cDNA sequences for mature human DNAM-1 are shown below.

```
Mature Human DNAM-1 Protein
                                    (SEQ ID NO: 11)
ee vlwhtsvpfa enmslecvyp smgiltqvew fkigtqqdsi aifspthgmv irkpyaervy flnstmasnn mtlffrnase ddvgyyscsl ytypqgtwqk viqvvqsdsf eaavpsnshi vsepgknvtl tcqpqmtwpv qavrwekigp rqidlltycn lvhgrnftsk fprqivsncs hgrwsvivip dvtvsdsgly rcylqasage netfvmrltv aegktdnqyt lfvaggtvll llfvisitti iviflnrrrr rerrdlftes wdtqkapnny rspistsqpt nqsmddtred iyvnyptfsr rpktrv Human DNAM-1 cDNA
                                    (SEQ ID NO: 12)
atggattatc ctactttact tttggctctt cttcatgtat acagagctct atgtgaagag gtgctttggc atacatcagt tcccttttgcc gagaacatgt ctctagaatg tgtgtatcca tcaatgggca tcttaacaca ggtggagtgg ttcaagatcg ggacccagca ggattccata gccattttca gccctactca tggcatggtc ataaggaagc cctatgctga gagggtttac tttttgaatt caacgatggc ttccaataac atgactcttt tctttcggaa tgcctctgaa gatgatgttg gctactattc ctgctctctt tacacttacc cacagggaac ttggcagaag gtgatacagg tggttcagtc agatagtttt gaggcagctg tgccatcaaa tagccacatt gtttcggaac tggaaagaa tgtcacactc acttgtcagc ctcagatgac gtggcctgtg caggcagtga ggtgggaaaa gatccagccc gtcagatcg acctcttaac ttactgcaac ttggtccatg gcagaaattt cacctccaag ttcccaagac aaatagtgag caactgcagc cacggaaggt ggagcgtcat cgtcatcccc gatgtcacag tctcagactc ggggctttac cgctgctact gcaggccag cgcaggagaa aacgaaacct tcgtgatgag attgactgta
```

The protein and cDNA sequences for mature human 2B4 are shown below.

```
Mature Human 2B4 Protein
                                    (SEQ ID NO: 13)
gk gcqgsadhvv sisgvplqlq pnsiqtkvds iawkkllpsq ngfhhilkwe ngslpsntsn drfsfivknl sllikaaqqq dsglyclevt sisgkvqtat fqvfvfdkve kprlqgqgki ldrgrcqval sclvsrdgnv syawyrgskl iqtagnltyl deevdingth tytcnvsnpv sweshtlnlt qdcqnahqef rfwpflviiv ilsalflgtl acfcvwrrkr kekqsetspk efltiyedvk dlktrrnheq eqtfpgggst iysmiqsqss aptsqepayt lysliqpsrk sgsrkrnhsp sfnstiyevi gksqpkaqnp arlsrkelen fdvys Human 2B4 cDNA
                                    (SEQ ID NO: 14)
atgctggggc aagtggtcac cctcatactc ctcctgctcc tcaaggtgta tcagggcaaa ggatgccagg atcagctga ccatgtggtt agcatctcgg gagtgcctct tcagttacaa ccaaacagca tacagacgaa ggttgacagc attgcatgga agaagttgct gccctcacaa aatggatttc atcacatatt gaagtgggag aatggctctt tgccttccaa tacttccaat gatagattca gttttatagt caagaacttg agtcttctca tcaaggcagc tcagcagcag acagtggcc tctactgcct ggaggtcacc agtatatctg gaaaagttca gacagccacg ttccaggttt ttgtatttga taaagttgag aaaccccgcc tacaggggca ggggaagatc ctggacagag ggagatgcca agtggctctg tcttgcttgg tctccaggga tggcaatgtg tcctatgctt ggtacagagg gagcaagctg atccagacag cagggaacct cacctacctg gacgaggagg ttgacattaa tggcactcac acatatacct gcaatgtcag caatcctgtt agctgggaaa gccacaccct gaatctcact caggactgtc agaatgccca tcaggaattc agattttggc cgttttttggt gatcatcgtg attctaagcg cactgttcct tggcacccct gcctgcttct gtgtgtggag gagaaagagg aaggagaagc
```

```
agtcagagac cagtcccaag gaattttga caatttacga agatgtcaag gatctgaaaa ccaggagaaa tcacgagcag gagcagactt ttcctggagg ggggagcacc atctactcta tgatccagtc ccagtcttct gctcccacgt cacaagaacc tgcatataca ttatattcat taattcagcc ttccaggaag tctggatcca ggaagaggaa ccacagccct tccttcaata gcactatcta tgaagtgatt ggaaagagtc aacctaaagc ccagaaccct gctcgattga gccgcaaaga gctggagaac tttgatgttt attcctag
```

The protein and cDNA sequences for mature human NKp30 are shown below.

```
Mature Human NKp30 Protein
                                    (SEQ ID NO: 15)
lw vsqppeirtl egssaflpcs fnasqgrlai gsvtwfrdev vpgkevrngt pefrgrlapl assrflhdhq aelhirdvrg hdasiyvcrv evlglgvgtg ngtrlvveke hpqlgagtvl llragfyavs flsvavgstv yyqgkcltwk gprrqlpavv paplpppcgs sahllppvpg g Human NKp30 cDNA
                                    (SEQ ID NO: 16)
atggcctgga tgctgttgct catcttgatc atggtccatc caggatcctg tgctctctgg gtgtcccagc ccctgagat tcgtaccctg gaaggatcct ctgccttcct gccctgctcc ttcaatgcca gccaaggaga actggccatt ggctccgtca cgtggttccg agatgaggtg gttccaggga aggaggtgag gaatggaacc ccagagttca ggggccgcct ggccccactt gcttcttccc gtttcctcca tgaccaccag gctgagctgc acatccggga cgtgcgaggc catgacgcca gcatctacgt gtgcagagtg gaggtgctgg gccttggtgt cgggacaggg aatgggactc ggctggtggt ggagaaagaa catcctcagc tagggctgg tacagtcctc ctccttcggg ctggattcta tgctgtcagc tttctctctg tggccgtggg cagcaccgtc tattaccagg gcaaatgcca ctgtcacatg gaacacact gccactcctc agatgggccc cgaggagtga ttccagagcc cagatgtccc tag
```

The protein and cDNA sequences for mature human NKp44 are shown below.

```
Mature Human NKp44 Protein
                                    (SEQ ID NO: 17)
qskaqvlqs vagqtltvrc qypptgslye kkgwckeasa lvcirlvtss kprtmawtsr ftiwddpdag fftvtmtdlr eedsghywcr iyrpsdnsvs ksvrfylvvs pasastqtsw
```

```
tprdlvssqt qtqscvppta garqapesps tipvpsqpqn stlrpgpaap ialvpvfcgl lvakslvlsa llvwwgdiww ktmmelrsld tqkatchlqq vtdlpwtsvs spvereilyh tvartkisdd ddehtl Human NKp44 cDNA
                                    (SEQ ID NO: 18)
atggcctggc gagccctaca cccactgcta ctgctgctgc tgctgttccc aggctctcag gcacaatcca aggctcaggt acttcaaagt gtggcagggc agacgctaac cgtgagatgc cagtacccgc ccacgggcag tctctacgag aagaaaggct ggtgtaagga ggcttcagca cttgtgtgca tcaggttagt caccagctcc aagcccagga cgatggcttg gacctctcga ttcacaatct gggacgaccc tgatgctggc ttcttcactg tcaccatgac tgatctgaga gaggaagact caggacatta ctggtgtaga atctaccgcc cttctgacaa ctctgtctct aagtccgtca gattctatct ggtggtatct ccagcctctg cctccacaca gacctcctgg actcccgcg acctggtctc ttcacagacc cagacccaga gctgtgtgcc tcccactgca ggagccagac aagcccctga gtctccatct accatccctg tcccttcaca gccacagaac tccacgctcc gccctggccc tgcagccccc attgccctgg tgcctgtgtt ctgtggactc ctcgtagcca agagcctggt gctgtcagcc ctgctcgtct ggtgggtttt aaggaatcgg cacatgcagc atcaagggag gtctctgctg cacccagctc agcccaggcc caggcccat agacacttcc cactgagcca cagggcacca gggggacat atggtggaaa accatga
```

The protein and cDNA sequences for mature human NKp46 are shown below.

```
Mature Human NKp46 Protein
                                    (SEQ ID NO: 19)
qqqtlpkpf iwaephfmvp kekqvticcq gnygaveyql hfegslfavd rpkpperink vqfyipdmns rmagqysciy rvgelwseps nlldlvvtem ydtptlsvhp gpevisgekv tfycrldtat smflllkegr sshvqrgygk vqaefplgpv ttahrgtyrc fgsynnhaws fpsepvkllv tgdientsla pedptfpadt wgtyllttet glqkdhalwd htaqnllrmg laflvlvalv wflvedwlsr krtrerasra stwegrrrln tqtl Human NKp46 cDNA
                                    (SEQ ID NO: 20)
atggcctggc gagccctaca cccactgcta ctgctgctgc tgctgttccc aggctctcag gcacaatcca aggctcaggt acttcaaagt gtggcagggc agacgctaac cgtgagatgc cagtacccgc ccacgggcag tctctacgag aagaaaggct
```

```
ggtgtaagga ggcttcagca cttgtgtgca tcaggttagt caccagctcc aagcccagga cgatggcttg gacctctcga ttcacaatct gggacgaccc tgatgctggc ttcttcactg tcaccatgac tgatctgaga gaggaagact caggacatta ctggtgtaga atctaccgcc cttctgacaa ctctgtctct aagtccgtca gattctatct ggtggtatct ccagcctctg cctccacaca gacctcctgg actccccgcg acctggtctc ttcacagacc cagacccaga gctgtgtgcc tcccactgca ggagccagac aagcccctga gtctccatct accatccctg tcccttcaca gccacagaac tccacgctcc gccctggccc tgcagccccc attgccctgg tgcctgtgtt ctgtggactc ctcgtagcca agagcctggt gctgtcagcc ctgctcgtct ggtgggtttt aaggaatcgg cacatgcagc atcaagggag gtctctgctg cacccagctc agcccaggcc ccaggcccat agacacttcc cactgagcca cagggcacca gggggggacat atggtggaaa accatga
```

The protein and cDNA sequences for mature human NKG2D are shown below.

```
Mature Human NKG2D Protein
                                      (SEQ ID NO: 21)
mgwirgrrsr hswemsefhn ynldlkksdf strwqkqrcp vvkskcrena spfffccfia vamgirfiim vaiwsavfln slfnqevqip ltesycgpcp knwicyknnc yqffdesknw yesqascmsq nasllkvysk edqdllklvk syhwmglvhi ptngswqwed gsilspnllt iiemqkgdca lyassfkgyi encstpntyi cmqrtv Human NKG2D cDNA
                                      (SEQ ID NO: 22)
atggggtgga ttcgtggtcg gaggtctcga cacagctggg agatgagtga atttcataat tataacttgg atctgaagaa gagtgatttt tcaacacgat ggcaaaagca aagatgtcca gtagtcaaaa gcaaatgtag agaaaatgca tctccatttt tttctgctg cttcatcgct gtagccatgg gaatccgttt cattattatg gtaacaatat ggagtgctgt attcctaaac tcattattca accaagaagt tcaaattccc ttgaccgaaa gttactgtgg cccatgtcct aaaaactgga tatgttacaa aaataactgc taccaatttt ttgatgagag taaaaactgg tatgagagcc aggcttcttg tatgtctcaa aatgccagcc ttctgaaagt atacagcaaa gaggaccagg atttacttaa actggtgaag tcatatcatt ggatgggact agtacacatt ccaacaaatg gatcttggca gtgggaagat ggctccattc tctcacccaa cctactaaca ataattgaaa tgcagaaggg
```

The protein and cDNA sequences for mature human CD16a are shown below.

```
Mature Human CD16a Protein
                                      (SEQ ID NO: 23)
maegtlwqil cvssdaqpqt fegvkgadpp tlppgsflpg pvlwwgslar lqteksdevs rkgnwwvtem gggagerlft ssclvglvpl glrislvtcp lqcgimwqll lptalllvs agmrtedlpk avvflepqwy rvlekdsvtl kcqgaysped nstqwfhnes lissqassyf idaatvddsg eyrcqtnlst lsdpvqlevh igwlllqapr wvfkeedpih lrchswknta lhkvtylqng kgrkyfhhns dfyipkatlk dsgsyfcrgl fgsknvsset vnititqgla vstissffpp gyqvsfclvm vllfavdtgl yfsvktnirs strdwkdhkf kwrkdpqdk Human CD16a cDNA
                                      (SEQ ID NO: 24)
atgctgaggg cacactctgg cagattctgt gtgtgtcctc agatgctca gccacagacc tttgagggag taaaggggca gacccaccac cttgcctc caggctcttt ccttcctggt cctgttctat ggtggggctc ccttgccaga cttcagactg agaagtcaga tgaagtttca agaaaaggaa attggtgggt gacagagatg ggtggagggg ctggggaaag gctgtttact tcctcctgtc tagtcggttt ggtcccttta gggctccgga tatctttggt gacttgtcca ctccagtgtg gcatcatgtg gcagctgctc ctcccaactg ctctgctact tctagtttca gctggcatgc ggactgaaga tctcccaaag gctgtggtgt tcctggagcc tcaatggtac agggtgctcg agaaggacag tgtgactctg aagtgccagg gagcctactc ccctgaggac aattccacac agtggtttca caatgagcct catctcaagc caggcctcga gctacttcat tgacgctg ccacagtcga cgacagtgga gagtacaggt gccagacaaa cctctccacc ctcagtgacc cggtgcagct agaagtccat atcggctggc tgttgctcca ggcccctcgg tgggtgttca aggaggaaga ccctattcac ctgaggtgtc acagctggaa gaacactgct ctgcataagg tcacatattt acagaatggc aaaggcagga agtattttca tcataattct gacttctaca ttccaaaagc cacactcaaa gacagcggct cctacttctg cagggggctt tttggagta aaaatgtgtc ttcagagact gtgaacatca ccatcactca aggtttggca gtgtcaacca tctcatcatt cttcccacct gggtaccaag tctctttctg cttggtgatg gtactccttt ttgcagtgga cacaggacta tatttctctg
``` tgaagacaaacattcgaagctcaacaagagactggaaggaccataaattt aaatggagaaaggaccctcaagacaaatga The protein and cDNA sequences for mature human CD16b are shown below.

```
Mature Human CD16b Protein
                                    (SEQ ID NO: 25)
mwqlllptal lllvsagmrt edlpkavvfl epqwysvlek dsvtlkcqga yspednstqw fhneslissq assyfidaat vndsgeyrcq tnlstlsdpv qlevhigwll lqaprwvfke edpihlrchs wkntalhkvt ylqngkdrky fhhnsdfhip katlkdsgsy fcrglvgskn vssetvniti tqglavstis sfsppgyqvs fclvmvllfa vdtglyfsvk tni
```

```
Human CD16b cDNA
                                    (SEQ ID NO: 26)
atgtggcagctgctcctcccaactgctctgctacttctagtttcagctgg catgcggactgaagatctcccaaaggctgtggtgttcctggagcctcaat ggtacagcgtgcttgagaaggacagtgtgactctgaagtgccagggagcc tactcccctgaggacaattccacacagtggtttcacaatgagaacctcat ctcaagccaggcctcgagctacttcattgacgctgccacagtcaacgaca gtggagagtacaggtgccagacaaacctctccaccctcagtgacccggtg cagctagaagtccatatcggctggctgttgctccaggcccctcggtgggt gttcaaggaggaagaccctattcacctgaggtgtcacagctggaagaaca ctgctctgcataaggtcacatatttcagaatggcaaagacaggaagtat tttcatcataattctgacttccacattccaaaagccacactcaaagatag cggctcctacttctgcaggggcttgttgggagtaaaaatgtgtcttcag agactgtgaacatcaccatcactcaaggtttggcagtgtcaaccatctca tcattctctccacctgggtaccaagtctctttctgcttggtgatggtact ccttttttgcagtggacacaggactatatttctctgtgaagacaaacattt ga
```

The protein and cDNA sequences for mature human KIR2DS1 are shown below.

```
Human KIR2DS1 Protein
                                    (SEQ ID NO: 27)
msltvvsmac vgffllqgaw phegvhrkps llahpgrlvk seetvilqcw sdvmfehfll hregmfndtl rligehhdgv skanfsisrm kqdlagtyrc ygsvthspyq vsapsdpldi viiglyekps lsaqpgptvl agesvtlscs srssydmyhl sregeaherr lpagtkvngt fqanfplgpa thggtyrcfg sfrdspyews kssdpllvsv tgnpsnswps ptepssetgn prhlhvligt svvkipftil lffllhrwcs dkknaavmdq epagnrtvns edsdeqdhqe vsya
```

```
Human KIR2DS1 cDNA
                                    (SEQ ID NO: 28)
atgtcgctcacggtcgtcagcatggcgtgtgttgggttcttcttgctgca gggggcctggccacatgagggagtccacagaaaaccttcctcctggccc acccaggtcgcctggtgaaatcagaagagacagtcatcctgcaatgttgg tcagatgtcatgtttgaacacttccttctgcacagagagggatgtttaa cgacactttgcgcctcattggagaacaccatgatgggggtctccaaggcca acttctccatcagtcgcatgaagcaagacctggcagggacctacagatgc tacggttctgttactcactcccccctatcagttgtcagctcccagtgaccc tctggacatcgtgatcataggtctatatgagaaaccttctctctcagccc agccgggccccacggttctggcaggagagaatgtgaccttgtcctgcagc tcccggagctcctatgacatgtaccatctatccagggaaggggaggccca tgaacgtaggctccctgcagggaccaaggtcaacggaacattccaggcca actttcctctgggccctgccacccatggagggacctacagatgcttcggc tcttttccgtgactctccatacgagtggtcaaagtcaagtgacccactgct tgtttctgtcacaggaaacccttcaaatagttggccttcacccactgaac caagctccgaaaccggtaaccccagacacctacatgttctgattgggacc tcagtggtcaaaatccctttcaccatcctcctcttctttctccttcatcg ctggtgctccgacaaaaaaaatgctgctgtaatggaccaagagcctgcag ggaacagaacagtgaacagcgaggattctgatgaacaagaccatcaggag gtgtcatacgcataa
```

The protein and cDNA sequences for mature human KIR2DS2 are shown below.

```
Human KIR2DS2 Protein
                                    (SEQ ID NO: 29)
mslmvvsmvc vgffllqgaw phegvhrkps llahpgplvk seetvilqcw sdvrfehfll hregkykdtl hligehhdgv skanfsigpm mqdlagtyrc ygsvthspyq lsapsdpldi vitglyekps lsaqpgptvl agesvtlscs srssydmyhl sregeaherr fsagpkvngt fqadfplgpa thggtyrcfg sfrdspyews nssdpllvsv tgnpsnswps ptepssktgn prhlhvligt svvkipftil lffllhrwcs nkknaavmdq epagnrtvns edsdeqdhqe vsya
```

```
Human KIR2DS2 cDNA
                                    (SEQ ID NO: 30)
atgtcgctcatggtcgtcagcatggcgtgtgttgggttcttcttgctgca gggggcctggccacatgagggagtccacagaaaaccttcctcctggccc acccaggtcccctggtgaaatcagaagagacagtcatcctgcaatgttgg tcagatgtcaggtttgagcacttccttctgcacagagagggaagtataa ggacactttgcacctcattggagcaccatgatgggtctccaaggcca acttctccatcggtcccatgatgcaagaccttgcagggacctacagatgc tacggttctgttactcactcccccctatcagttgtcagctcccagtgaccc tctggacatcgtcatcacaggtctatatgagaaaccttctctctcagccc
```

```
agccgggccccacggttttggcaggagagagcgtgaccttgtcctgcagc tcccggagctcctatgacatgtaccatctatccagggaggggaggccca tgaacgtaggttctctgcagggcccaaggtcaacggaacattccaggccg actttcctctgggccctgccacccacggaggaacctacagatgcttcggc tctttccgtgactctccctatgagtggtcaaactcgagtgacccactgct tgtttctgtcacaggaaaaccttcaaatagttggccttcacccactgaac caagctccaaaaccggtaaccccagacacctgcatgttctgattgggacc tcagtggtcaaaatcccttccaccatcctcctcttctttctccttcatcg ctggtgctccaacaaaaaaatgctgctgtaatggaccaagagcctgcag ggaacagaacagtgaacagcgaggactctgatgaacaagaccctcaggag gtgacatacacacagttgaatcactgcgttttcacacagagaaaaatcac tcgcccttctcagaggcccaagacaccccaacagatatcatcgtgtaca cggaacttccaaatgctgagtccaga
```

The protein and cDNA sequences for mature human KIR2DS3 are shown below.

```
Mature Human KIR2DS3 Protein
                                        (SEQ ID NO: 31)
mslmvismac vgffwlqgaw phegfrrkps llahpgrlvk seetvilqcw sdvmfehfll hregtfndtl rligehidgv skanfsigrm rqdlagtyrc ygsvphspyq fsapsdpldi vitglyekps lsaqpgptvl agesvtlscs swssydmyhl stegeaherr fsagpkvngt fqadfplgpa tqggtyrcfg sfhdspyews kssdpllvsv tgnpsnswps ptepssktgn prhlhvligt svvklpftil lffllhrwcs dkknasvmdq gpagnrtvnr edsdeqdhqe vsya Human KIR2DS3 cDNA
                                        (SEQ ID NO: 32)
atgtcgctcatggtcatcagcatggcatgtgttgggttcttctggctgca gggggcctggccacatgagggattccgcagaaaaccttcctcctggcc acccaggtcgcctggtgaaatcagaagagacagtcatcctgcaatgttgg tcagatgtcatgtttgagcacttccttctgcacagagaggggacgtttaa cgacactttgcgcctcattggagagcacattgatggggtctccaaggcca acttctccatcggtcgcatgaggcaagacctggcagggacctacagatgc tacggttctgttcctcactcccctatcagttttcagctcccagtgaccc tctggacatcgtgatcacaggtctatatgagaaacctctctctcagccc agccgggcccacggttctggcaggagagagcgtgaccttgtcctgcagc tcctggagctcctatgacatgtaccatctatccacggaggggaggccca tgaacgtaggttctctgcagggcccaaggtcaacggaacattccaggccg actttcctctgggccctgccacccaaggaggaacctacagatgcttcggc tctttccatgactctccctacgagtggtcaaagtcaagtgacccactgct tgtttctgtcacaggaaaaccttcaaatagttggccttcacccactgaac caagctccaaaaccggtaaccccagacacctacacgttctgattgggacc tcagtggtcaaactcccttttcaccatcctcctcttctttctccttcatcg ctggtgctccgacaaaaaaatgcatctgtaatggaccaagggcctgcgg ggaacagaacagtgaacagggaggattctgatgaacaggaccatcaggag gtgtcatacgcataa
```

The protein and cDNA sequences for mature human KIR2DL4 are shown below.

```
Mature Human KIR2DL4 Protein
                                        (SEQ ID NO: 33)
hvggqdk pfcsawpsav vpqgghatlr cherrgfnif tlykkdgvpv pelynrifwn sflispvtpa hagtyrcrgf hphsptewsa psnplvimvt glyekpslta rpgptvrage nvtlscssqs sfdiyhlsre geahelrlpa vpsingtfqa dfplgpathg etyrcfgsfh gspyewsdps dplpvsvtgn pssswpspte psfktgiarh lhavirysva iilftilpff llhrwcskkk naavmngepa ghrtvnreds deqdpqevty aqldhciftq rkitgpsqrs krpstdtsvc ielpnaepra lspahehhsq almgssrett alsqtqlass nvpaagi Human KIR2DL4 cDNA
                                        (SEQ ID NO: 34)
atgtcccttcacatgttgtggtcaatgtgtcaactgcacgatccgggcc cctcaccacatcctctgcaccggtcagtcgagccgagtcactgcgtcctg gcagcagaagctgcaccatgtccatgtcacccacggtcatcatcctggca tgtcttggggttcttcttggaccagagtgtgtgggcacacgtgggtggtca ggacaagcccttctgctctgcctggcccagcgctgtggtgcctcaaggag gacacgtgactcttcggtgtcactatcgtcgtgggtttaacatcttcacg ctgtacaagaaagatggggtccctgtccctgagctctacaacagaatatt ctggaacagtttcctcattagccctgtgaccccagcacacgcagggacct acagatgtcgaggttttcacccgcactccccactgagtggtcggcaccc agcaaccccctggtgatcatggtcacaggtctatatgagaaaccttcgct tacagcccggccgggcccacggttcgcgcaggagagaacgtgaccttgt cctgcagctcccagagctcctttgacatctaccatctatccaggggagggg gaagcccatgaacttaggctccctgcagtgccagcatcaatggaacatt ccaggccgacttccctctgggtcctgccacccacggagagacctacagat gcttcggctcttttccatggatctccctacgagtggtcagacccgagtgac ccactgcctgttctgtcacaggaaaaccttctagtagttggccttcacc cactgaaccaagcttcaaaactggtatcgccagacacctgcatgctgtga ttaggtactcagtggccatcatcctcttaccatccttcccttctttctc cttcatcgctggtgctccaaaaaaaagatgctgctgtaatgaaccaaga gcctgcgggacacagaacagtgaacagggaggactctgatgaacaagacc ctcaggaggtgacatacgcacagttggatcactgcattttcacacagaga aaaatcactggcccttctcagaggagcaagagacccaacagataccag cgtgtgtatagaacttccaaatgctgagcccagagcgttgtctcctgccc
```

-continued

```
atgagcaccacagtcaggccttgatgggatcttctagggagacaacagcc
ctgtctcaaacccagcttgccagctctaatgtaccagcagctggaatctg
a
```

The protein and cDNA sequences for mature human KIR2DS4 are shown below.

Mature Human KIR2DS4 Protein
(SEQ ID NO: 35)
```
qegvhrkps flalpghlvk seetvilqcw sdvmfehfll
hregkfnntl hligehhdgv skanfsigpm mpvlagtyrc
yssvphspyq lsapsdpldm viiglyekps lsaqpgptvq
agenvslscs siypgrgrpm nvgslqcaas tehsrptflw
alpptegptd asalsvtlpt sgqtrvihcl fpsqetlqiv
glhplnqapk pvtpdtymf
```

Human KIR2DS4 cDNA
(SEQ ID NO: 36)
```
atgtcgctcatggtcatcatcatggcgtgtgttgggttcttcttgctgca
gggggcctggccacaggagggagtccacagaaaaccttccttcctggccc
tcccaggtcacctggtgaaatcagaagagacagtcatcctgcaatgttgg
tcggatgtcatgtttgagcacttccttctgcacagagaggggaagtttaa
caacactttgcacctcattggagagcaccatgatggggtttccaaggcca
acttctccattggtcccatgatgcctgtccttgcaggaacctacagatgc
tacggttctgttcctcactcccccctatcagttgtcagctcccagtgaccc
tctggacatggtgatcataggtctatatgagaaaccttctctctcagccc
agccgggccccacggttcaggcaggagagaatgtgaccttgtcctgcagc
tccatctatccagggaaggggaggcccatgaacgtaggctccctgcagtg
cgcagcatcaacggaacattccaggccgactttcctctgggccctgccac
ccacggagggacctacagatgcttcggctctttccgtgacgctccctacg
agtggtcaaactcgagtgatccactgcttgtttccgtcacaggaaacct
tcaaatagttggccttcacccactgaaccaagctccaaaaccggtaaccc
cagacacctacatgttctgattgggacctcagtggtcaaaatccctttca
ccatcctcctcttctttctccttcatcgctggtgctccgacaaaaaaaat
gctgctgtaatggaccaagagcctgcagggaacagaacagtgaacagcga
ggattctgatgaacaagaccatcaggaggtgtcatacgcataa
```

The protein and cDNA sequences for mature human KIR2DS5 are shown below.

Mature Human KIR2DS5
(SEQ ID NO: 37)
```
hegfrrkps llahpgplvk seetvilqcw sdvmfehfll
hregtfnhtl rligehidgv skgnfsigrm tqdlagtyrc
ygsvthspyq lsapsdpldi vitglyekps lsaqpgptvl
agesvtlscs srssydmyhl sregeaherr lpagtkvngt
fqadfpldpa thggtyrcfg sfrdspyews kssdpllvsv
tgntsnswps ptepssktgn prhlhvligt svvklpftil
lffllhrwcs nkknasvmdq gpagnrtvnr edsdeqdhqe vsya
```

Human KIR2DS5 cDNA
(SEQ ID NO: 38)
```
atgtcgctcatggtcatcagcatggcgtgtgttgcgttcttcttgctgca
gggggcctggccacatgagggattccgcagaaaaccttccctcctggccc
acccaggtccctggtgaaatcagaagagacagtcatcctgcaatgttgg
tcagatgtcatgtttgagcacttccttctgcacagagaggggacgtttaa
ccacactttgcgcctcattggagagcacattgatggggtctccaagggca
acttctccatcggtcgcatgacacaagacctggcagggacctacagatgc
tacggttctgttactcactcccccctatcagttgtcagcgcccagtgaccc
tctggacatcgtgatcacaggtctatatgagaaaccttctctctcagccc
agccgggccccacggttctggcaggagagagcgtgaccttgtcctgcagc
tcccggagctcctatgacatgtaccatctatccaggggaaggggaggccca
tgaacgtaggctccctgcagggcccaaggtcaacagaacattccaggccg
acttcctctggaccctgccacccacggagggacctacagatgcttcggc
tcttccgtgactctccatacgagtggtcaaagtcaagtgacccactgct
tgtttctgtcacaggaaactcttcaaatagttggccttcacccactgaac
caagctccgaaaccggtaaccccagacacctacacgttctgattgggacc
tcagtggtcaaactccctttcaccatcctcctcttctttctccttcatcg
ctggtgctccaacaaaaaaaatgcatctgtaatggaccaagggcctgcgg
ggaacagaacagtgaacagggaggattctgatgaacaggaccatcaggag
gtgtcatacgcataa
```

The protein and cDNA sequences for mature human KIR3DS1 are shown below.

Mature Human KIR3DS1 cDNA
(SEQ ID NO: 39)
```
hmggqdkpf lsawpsavvp rgghvtlrch yrhrfnnfml
ykedrihvpi fhgrifqegf nmspvttaha gnytorgshp
hsptgwsaps npmvimvtgn hrkpsllahp gplvksgerv
ilqcwsdimf ehfflhkegi skdpsrlvgq ihdgvskanf
sigsmmrala gtyrcygsvt htpyqlsaps dpldivvtgl
yekpslsaqp gpkvqagesv tlscssrssy dmyhlsregg
aherrlpavr kvnrtfqadf plgpathggt yrcfgsfrhs
pyewsdpsdp llvsvtgnps sswpspteps sksgnlrhlh
iligtsvvki pftillffll hrwcsnkkkc congpracre qk
```

Human KIR3DS1 cDNA
(SEQ ID NO: 40)
```
atgttgctcatggtcgtcagcatggcgtgtgttgggttgttcttggtcca
gagggccggtccacacatgggtggtcaggacaagcccttcctgtctgcct
ggccagcgctgtggtgcctcgcggaggacacgtgactcttcggtgtcac
tatcgtcataggtttaacaatttcatgctatacaaagaagacagaatcca
cgttcccatcttccatggcagaatattccaggagggcttcaacatgagcc
```

-continued

```
ctgtgaccacagcacatgcagggaactacacatgtcggggttcacaccca
cactcccccactgggtggtcggcacccagcaaccccatggtgatcatggt
cacaggaaaccacagaaaaccttcctcctggcccacccaggtcccctgg
tgaaatcaggagagagagtcatcctgcaatgttggtcagatatcatgttt
gagcacttctttctgcacaaagagtggatctctaaggacccctcacgcct
cgttggacagatccatgatggggtctccaaggccaatttctccatcggtt
ccatgatgcgtgcccttgcagggacctacagatgctacggttctgttact
cacacccctatcagttgtcagctcccagtgatcccctggacatcgtggt
cacaggtctatatgagaaaccttctctctcagcccagccgggcccccaagg
ttcaggcaggagagagcgtgaccttgtcctgtagctcccggagctcctat
gacatgtaccatctatccagggaggggggagcccatgaacgtaggctccc
tgcagtgcgcaaggtcaacagaacattccaggcagatttccctctgggcc
ctgccacccacggagggacctacagatgcttcggctcttttccgtcactct
ccctacgagtggtcagacccgagtgacccactgcttgtttctgtcacagg
aaaaccttcaagtagttggccttcaccacagaaccaagctccaaatctg
gtaacctcagacacctgcacattctgattgggacctcagtggtcaaaatc
cctttcaccatcctcctcttctttctccttcatcgctggtgctccaacaa
aaaaaaatgctgctgtaatggaccaagagcctgcagggaacagaagtga
```

The protein and cDNA sequences for mature human NKG2C are shown below.

Mature Human NKG2C Protein
(SEQ ID NO: 41)

mskqrgtfse vslaqdpkrq qrkpkgnkss isgteqeifq
velnlqnpsl nhqgidkiyd cqglippeek ltaevlgiic
ivlmatvikt ivlipfleqn nsspntrtqk arhcghcpee
witysnscyy igkerrtwee sllactskns sllsidneee
mkflasilps swigvfrnss hhpwvtingl afkhkikdsd
naelncavlq vnrlksaqcg ssmiyhckhk l Human NKG2C cDNA
(SEQ ID NO: 42)

```
atgaataaacaaagaggaaccttctcagaagtgagtctggcccaggaccc
aaagcggcagcaaaggaaacctaaaggcaataaaagctccatttcaggaa
ccgaacaggaaatattccaagtagaattaaatcttcaaaatccttccctg
aatcatcaagggattgataaaatatatgactgccaaggtttactgccacc
tccagagaagctcactgccgaggtcctaggaatcatttgcattgtcctga
tggccactgtgttaaaaacaatagttcttattcctttcctggagcagaac
aattttccccgaatacaagaacgcagaaagcacgtcattgtggccattg
tcctgaggagtggattacatattccaacagttgttattacattggtaagg
aaagaagaacttgggaagagagtttgctggcctgacttcgaagaactcc
agtctgctttctatagataatgaagaagaaatgaaattttctggccagcat
tttaccttcctcatggattggtgtgtttcgtaacagcagtcatcatccat
gggtgacaataaatggttttggcttcaaacataagataaaagactcagat
```

-continued

```
aatgctgaacttaactgtgcagtgctacaagtaaatcgacttaaatcagc
ccagtgtggatcttcaatgatatatcattgtaagcataagctttag
```

The protein and cDNA sequences for mature human CCR7 are shown below.

Mature Human CCR7 Protein
(SEQ ID NO: 43)

qdevtd dyigdnttvd ytlfeslcsk kdvrnfkawf lpimysiicf
vgllgnglvv ltyiyfkrlk tmtdtyllnl avadilfllt
lpfwaysaak swvfgvhfck lifaiykmsf fsgmllllci
sidryvaivq avsahrhrar vllisklscv giwilatvls
ipellysdlq rssseqamrc slitehveaf itiqvaqmvi
gflvpllams fcylviirtl lqarnfernk aikviiavvv
vfivfqlpyn gvvlaqtvan fnitsstcel skqlniaydv
tyslacvrcc vnpflyafig vkfrndlfkl fkdlgclsqe
qlrqwsscrh irrssmsvea ettttfsp Human CCR7 cDNA
(SEQ ID NO: 44)

```
atggacctggggaaaccaatgaaaagcgtgctggtggtggctctccttgt
cattttccaggtatgcctgtgtcaagatgaggtcacggacgattacatcg
gagacaacaccacagtggactacactttgttcgagtctttgtgctccaag
aaggacgtgcggaactttaaagcctggttcctccctatcatgtactccat
catttgtttcgtgggcctactgggcaatgggctggtcgtgttgacctata
tctatttcaagaggctcaagaccatgaccgatacctacctgctcaacctg
gcggtggcagacatcctcttcctcctgacccttcccttctgggcctacag
cgcggccaagtcctgggtcttcggtgtccacttttgcaagctcatctttg
ccatctacaagatgagcttcttcagtggcatgctcctacttctttgcatc
agcattgaccgctacgtggccatcgtccaggctgtctcagctcaccgcca
ccgtgcccgcgtccttctcatcagcaagctgtcctgtgtgggcatctgga
tactagccacagtgctctccatcccagagctcctgtacagtgacctccag
aggagcagcagtgagcaagcgatgcgatgctctctcatcacagagcatgt
ggaggcctttatcaccatccaggtggcccagatggtgatcggctttctgg
tcccctgctggccatgagcttctgttaccttgtcatcatccgcaccctg
ctccaggcacgcaactttgagcgcaacaaggccatcaaggtgatcatcgc
tgtggtcgtggtcttcatagtcttccagctgccctacaatggggggtcc
tggcccagacggtggccaacttcaacatcaccagtagcacctgtgagctc
agtaagcaactcaacatcgcctacgacgtcacctacagcctggcctgcgt
ccgctgctgcgtcaaccctttcttgtacgccttcatcggcgtcaagttcc
gcaacgatctcttcaagctcttcaaggacctgggctgcctcagccaggag
``` cagctccggcagtggtcttcctgtcggcacatccggcgctcctccatgag tgtggaggccgagaccaccaccaccttctccccatag The protein and cDNA sequences for mature human CXCR3 are shown below.

Mature Human CXCR3 Protein
(SEQ ID NO: 45)
mvlevsdhqv lndaevaall enfsssydyg enesdsccts ppcpqdfsln fdraflpaly sllfllgllg ngavaavlls rrtalsstdt fllhlavadt llvltlplwa vdaavqwvfg sglckvagal fninfyagal llacisfdry lnivhatqly rrgpparvtl tclavwglcl lfalpdfifl sahhderlna thcqynfpqv grtalrvlql vagfllpllv maycyahila vllvsrgqrr lramrlvvvv vvafalcwtp yhlvvlvdil mdlgalarnc gresrvdvak svtsglgymh cclnpllyaf vgvkfrermw mlllrlgcpn qrglqrqpss srrdsswset seasysgl Human CXCR3 cDNA
(SEQ ID NO: 46)
atggagttgaggaagtacggccctggaagactggcggggacagttatagg aggagctgctcagagtaaatcacagactaaatcagactcaatcacaaaag agttcctgccaggccttttacacagccccttcctcccgttcccgccctca caggtgagtgaccaccaagtgctaaatgacgccgaggttgccgccctcct ggagaacttcagctcttcctatgactatgagaaaacgagagtgactcgt gctgtacctccccgccctgcccacaggacttcagcctgaacttcgaccgg gccttcctgccagccctctacagcctcctctttctgctggggctgctggg caacggcgcggtggcagccgtgctgctgagccggcggacagccctgagca gcaccgacaccttcctgctccacctagctgtagcagacacgctgctggtg ctgacactgccgctctgggcagtggacgctgccgtccagtgggtctttgg ctctggcctctgcaaagtggcaggtgccctcttcaacatcaacttctacg caggagccctcctgctggcctgcatcagctttgaccgctacctgaacata gttcatgccacccagctctaccgccgggggccccggcccgcgtgaccct cacctgcctggctgtctgggggctctgcctgctttttcgcctcccagact tcatcttcctgtcggcccaccacgacgagcgcctcaacgccacccactgc caatacaacttcccacaggggccgcacggctctgcgggtgctgcagct ggtggctggctttctgctgcccctgctggtcatggcctactgctatgccc acatcctggccgtgctgctggtttccaggggccagcggccctgcgggcc atgcggctggtggtggtggtcgtggtggcctttgccctctgctggacccc ctatcacctggtggtgctggtggacatcctcatggacctgggcgctttgg cccgcaactgtggccgagaaagcagggtagacgtggccaagtcggtcacc tcaggcctgggctacatgcactgctgcctcaaccgctgctctatgcctt tgtagggtcaagttccgggagcggatgtggatgctgctcttgcgcctgg gctgccccaaccagagagggctccagaggcagccatcgtcttcccgccgg gattcatcctggtctgagacctcagaggcctcctactcgggcttgtga The protein and cDNA sequences for mature human L-selectin are shown below.

Mature Human L-Selectin Protein
(SEQ ID NO: 47)
df lahhgtdcwt yhysekpmnw qrarrfordn ytdlvaiqnk aeieylektl pfsrsyywig irkiggiwtw vgtnksltee aenwgdgepn nkknkedcve iyikrnkdag kwnddachkl kaalcytasc qpwscsghge cveiinnytc ncdvgyygpq cqfviqcepl eapelgtmdc thplgnfsfs sqcafscseg tnltgieett cgpfgnwssp eptcqviqce plsapdlgim ncshplasfs ftsactfics egteligkkk ticessgiws npspicqkld ksfsmikegd ynplfipvav mvtafsglaf iiwlarrlkk gkkskrsmnd py Human L-Selectin cDNA
(SEQ ID NO: 48)
atgggctgcagaagaactagagaaggaccaagcaaagccatgatatttcc atggaaatgtcagagcacccagagggacttatggaacatcttcaagttgt gggggtggacaatgctctgttgtgatttcctggcacatcatggaaccgac tgctggacttaccattattctgaaaaacccatgaactggcaaagggctag aagattctgccgagacaattacacagatttagttgccatacaaaacaagg cggaaattgagtatctggagaagactctgcctttcagtcgttcttactac tggataggaatccggaagataggaggaatatggacgtgggtgggaaccaa caaatctcttactgaagaagcagagaactggggagatggtgagcccaaca acaagaagaacaaggaggactgcgtggagatctatatcaagagaaacaaa gatgcaggcaaatggaacgatgacgcctgccacaaactaaaggcagccct ctgttacacagcttcttgccagccctggtcatgcagtggccatggagaat gtgtagaaatcatcaataattacacctgcaactgtgatgtggggtactat gggcccagtgtcagtttgtgattcagtgtgagcctttggaggcccaga gctgggtaccatggactgtactcacccttgggaaacttcagcttcagct cacagtgtgccttcagctgctctgaaggaacaaacttaactgggattgaa gaaccacctgtgaccatttggaaactggtcatctccagaaccaacctg tcaagtgattcagtgtgagcctctatcagcaccagatttggggatcatga actgtagccatcccctggccagcttcagcttacctctgcatgtaccttc atctgctcagaaggaactgagttaattgggaagaagaaaaccatttgtga atcatctggaatctggtcaaatcctagtccaatatgtcaaaaattggaca aaagtttctcaatgattaaggagggtgattataacccctcttcattcca gtggcagtcatggttactgcattctctgggttggcatttatcatttggct ggcaaggagatt aaaaaaaggc aagaaatccaa gagaagtatga atgacc catattaa The protein and cDNA sequences for mature human CXCR1 are shown below.

Mature Human CXCR1 Protein
(SEQ ID NO: 49)
msnitdpqmw dfddlnftgm ppadedyspc xletetlnky vviiayalvf llsllgnslv mlvilysrvg rsvtdvylln laladllfal tlpiwaaskv ngwifgtflc kvvsllkevn fysgilllac isvdrylaiv hatrtltqkr hlvkfvclgc wglsmnlslp fflfrqayhp nnsspvcyev lgndtakwrm vlrilphtfg fivplfvmlf cygftlrtlf kahmgqkhra mrvifavvli fllcwlpynl vlladtlmrt qvigescerr nnigraldat eilgflhscl npiiyafigq nfrhgflkil amhglvskef larhrvtsyt sssvnvssnl Human CXCR1 cDNA
(SEQ ID NO: 50)
atgtcaaatattacagatccacagatgtgggattttgatgatctaaattt cactggcatgccacctgcagatgaagattacagcccctgtatgctagaaa ctgagacactcaacaagtatgttgtgatcatcgcctatgccctagtgttc ctgctgagcctgctgggaaactccctggtgatgctggtcatcttatacag cagggtcggccgctccgtcactgatgtctacctgctgaacctggccttgg ccgacctactctttgccctgaccttgcccatctgggccgcctccaaggtg aatggctggatttttggcacattcctgtgcaaggtggtctcactcctgaa ggaagtcaacttctacagtggcatcctgctgttggcctgcatcagtgtgg accgttacctggccattgtccatgccacacgcacactgacccagaagcgt cacttggtcaagtttgtttgtcttggctgctggggactgtctatgaatct gtccctgccttcttccttttccgccaggcttaccatccaaacaattcca gtccagtttgctatgaggtcctgggaaatgacacagcaaatggcggatg gtgttgcggatcctgcctcacacctttggcttcatcgtgccgctgtttgt catgctgttctgctatggattcaccctgcgtacactgtttaaggccaca tggggcagaagcaccgagccatgagggtcatctttgctgtcgtcctcatc ttcctgctttgctggctgccctacaacctggtcctgctggcagacaccct catgaggacccaggtgatccaggagagctgtgagcgccgcaacaacatcg gccgggccctggatgccactgagattctgggatttctccatagctgcctc aaccccatcatctacgccttcatcggccaaaattttcgccatggattcct caagatcctggctatgcatggcctggtcagcaaggagttcttggcacgtc The protein and cDNA sequences for mature human CXCR2 are shown below.

atcgtgttacctcctacacttcttcgtctgtcaatgtctcttccaacctc tga

Mature Human CXCR2 Protein
(SEQ ID NO: 51)
medfnmesds fedfwkgedl snysysstlp pflldaapce pesleinkyf vviiyalvfl lsllgnslvm lvilysrvgr svtdvyllnl aladllfalt lpiwaaskvn gwifgtflck vvsllkevnf ysgilllaci svdrylaivh atrtltqkry lvkficlsiw glslllalpv llfrrtvyss nvspacyedm gnntanwrml lrilpqsfgf ivpllimlfc ygftlrtlfk ahmgqkhram rvifavvlif llcwlpynlv lladtlmrtq viqetcerrn hidraldate ilgilhscln pliyafigqk frhgllkila ihgliskdsl pkdsrpsfvg sssghtsttl Human CXCR2 cDNA
(SEQ ID NO: 52)
atggaagatttttaacatggagagtgacagctttgaagatttctggaaagg tgaagatcttagtaattacagttacagctctaccctgccccttttctac tagatgccgccccatgtgaaccagaatccctggaaatcaacaagtatttt gtggtcattatctatgccctggtattcctgctgagcctgctgggaaactc cctcgtgatgctggtcatcttatacagcagggtcggccgctccgtcactg atgtctacctgctgaacctagccttggccgacctactctttgccctgacc ttgcccatctgggccgcctccaaggtgaatggctggattttttggcacatt cctgtgcaaggtggtctcactcctgaaggaagtcaacttctatagtggca tcctgctactggcctgcatcagtgtggaccgttacctggccattgtccat gccacacgcacactgacccagaagcgctacttggtcaaattcatatgtct cagcatctggggtctgtccttgctcctggccctgcctgtcttacttttcc gaaggaccgtctactcatccaatgttagcccagcctgctatgaggacatg ggcaacaatacagcaaactggcggatgctgttacggatcctgccccagtc ctttggcttcatcgtgccactgctgatcatgctgttctgctacggattca ccctgcgtacgctgtttaaggccacatggggcagaagcaccgggccatg cgggtcatctttgctgtcgtcctcatcttcctgctctgctggctgcccta caacctggtcctgctggcagacaccctcatgaggacccaggtgatccagg agacctgtgagcgccgcaatcacatcgacgggctctggatgccaccgag attctgggcatccttcacagctgcctcaaccccctcatctacgccttcat tggccagaagtttcgccatggactcctcaagattctagctatacatggct -continued

```
tgatcagcaaggactccctgcccaaagacagcaggccttcctttgttggc tcttcttcagggcacacttccactactctctaa
```

The protein and cDNA sequences for mature human CX3CR1 are shown below.

Mature Human CX3CR1 Protein
(SEQ ID NO: 53)
```
mdqfpesvte nfeyddlaea cyigdivvfg tvflsifysv ifaiglvgnl lvvfaltnsk kpksvtdiyl lnlalsdllf vatlpfwthy linekglhna mckfttafff igffgsiffi tvisidryla ivlaansmnn rtvqhgvtis lgvwaaailv aapqfmftkq keneclgdyp evlqeiwpvl rnvetnflgf llpllimsyc yfriiqtlfs cknhkkakai klillvvivf flfwtpynvm ifletlklyd ffpscdmrkd lrlalsvtet vafshcclnp liyafagekf rrylyhlygk clavlcgrsv hvdfsssesq rsrhgsvlss nftyhtsdgd alll
```

Human CX3CR1 cDNA
(SEQ ID NO: 54)
```
atggatcagttccctgaatcagtgacagaaaactttgagtacgatgattt ggctgaggcctgttatattggggacatcgtggtctttgggactgtgttcc tgtccatattctactccgtcatctttgccattggcctggtgggaaatttg ttggtagtgtttgccctcaccaacagcaagaagcccaagagtgtcaccga catttacctcctgaacctggccttgtctgatctgctgtttgtagccactt tgcccttctggactcactatttgataaatgaaaagggcctccacaatgcc atgtgcaaattcactaccgccttcttcttcatcggctttttttggaagcat attcttcatcaccgtcatcagcattgataggtacctggccatcgtcctgg ccgccaactccatgaacaaccggaccgtgcagcatggcgtcaccatcagc ctaggcgtctgggcagcagccattttggtggcagcaccccagttcatgtt cacaaagcagaaagaaaatgaatgccttggtgactaccccgaggtcctcc aggaaatctggcccgtgctccgcaatgtggaaacaaattttcttggcttc ctactccccctgctcattatgagttattgctacttcagaatcatccagac gctgttttcctgcaagaaccacaagaaagccaaagccattaaactgatcc ttctggtggtcatcgtgttttttcctcttctggacaccctacaacgttatg attttcctggagacgcttaagctctatgacttctttcccagttgtgacat gaggaaggatctgaggctggccctcagtgtgactgagacggttgcattta gccattgttgcctgaatcctctcatctatgcatttgctggggagaagttc agaagataccttaccacctgtatgggaaatgcctggctgtcctgtgtgg gcgctcagtccacgttgatttctcctcatctgaatcacaaaggagcaggc
```

The protein and cDNA sequences for mature human ChemR23 are shown below.

Mature Human ChemR23 Protein
(SEQ ID NO: 55)
```
mrmededynt sisygdeypd yldsivvled lsplearvtr iflvvvysiv cflgilgngl viiiatfkmk ktvnmvwfln lavadflfnv flpihityaa mdyhwvfgta mckisnflli hnmftsvfll tiissdrcis vllpvwsqnh rsvrlaymac mviwvlaffl sspslvfrdt anlhgkiscf nnfslstpgs sswpthsqmd pvgysrhmvv tvtrflcgfl vpvliitacy ltivcklqrn rlaktkkpfk iivtiiitff lcwcpyhtln llelhhtamp gsvfslglpl atalaiansc mnpilyvimg qdfkkfkval fsrlvnalse dtghssypsh rsftkmssmn ertsmneret gml
```

Human ChemR23 cDNA
(SEQ ID NO: 56)
```
atgagaatggaggatgaagattacaacacttccatcagttacggtgatga ataccctgattatttagactccattgtggttttggaggacttatccccct tggaagccagggtgaccaggatcttcctggtggtggtctacagcatcgtc tgcttcctcgggattctgggcaatggtctggtgatcatcattgccacctt caagatgaagaagacagtgaacatggtctggttcctcaacctggcagtgg cagatttcctgttcaacgtcttcctcccaatccatatcacctatgccgcc atggactaccactgggttttcgggacagccatgtgcaagatcagcaactt ccttctcatccacaacatgttcaccagcgtcttcctgctgaccatcatca gctctgaccgctgcatctctgtgctcctccctgtctggtcccagaaccac cgcagcgttcgcctggcttacatggcctgcatggtcatctgggtcctggc tttcttcttgagttccccatctctcgtcttccgggacacagccaacctgc atgggaaaatatcctgcttcaacaacttcagcctgtccacacctgggtct tcctcgtggcccactcactcccaaatggaccctgtggggtatagccggca catggtggtgactgtcacccgcttcctctgtggcttcctggtcccagtcc tcatcatcacagcttgctacctcaccatcgtgtgcaaactgcagcgcaac cgcctggccaagaccaagaagcccttcaagattattgtgaccatcatcat taccttcttcctctgctggtgccctaccacacactcaacctcctagagc tccaccacactgccatgcctggctctgtcttcagcctgggtttgccctg gccactgcccttgccattgccaacagctgcatgaacccattctgtatgt tttcatgggtcaggacttcaagaagttcaaggtggcccttcttctcgcc tggtcaatgctctaagtgaagatacaggccactcttcctaccccagccat
```

```
agaagctttaccaagatgtcatcaatgaatgagaggacttctatgaatga gagggagaccggcatgctttga
```

The protein and cDNA sequences for mature human CXCR4 are shown below.

```
Mature Human CXCR4 Protein
                                          (SEQ ID NO: 57)
megisiytsd nyteemgsgd ydsmkepcfr eenanfnkif lptiysiifl tgivgnglvi lvmgyqkklr smtdkyrlhl svadllfvit lpfwavdava nwyfgnflck avhviytvnl yssvlilafi sldrylaivh atnsqrprkl laekvvyvgv wipallltip dfifanvsea ddryicdrfy pndlwvvvfq fqhimvglil pgivilscyc iiisklshsk ghqkrkalkt tvililaffa cwlpyyigis idsfilleii kqgcefentv hkwisiteal affhcclnpi lyaflgakfk tsaqhaltsv srgsslkils kgkrgghssv stesesssfh ss
```

```
Human CXCR4 cDNA
                                          (SEQ ID NO: 58)
atgtccattcctttgcctcttttgcagatatacacttcagataactacac cgaggaaatgggctcaggggactatgactccatgaaggaaccctgtttcc gtgaagaaaatgctaatttcaataaaatcttcctgcccaccatctactcc atcatcttcttaactggcattgtgggcaatggattggtcatcctggtcat gggttaccagaagaaactgagaagcatgacggacaagtacaggctgcacc tgtcagtggccgacctcctctttgtcatcacgcttcccttctgggcagtt gatgccgtggcaaactggtactttgggaacttcctatgcaaggcagtcca tgtcatctacacagtcaacctctacagcagtgtcctcatcctggccttca tcagtctggaccgctacctggccatcgtccacgccaccaacagtcagagg ccaaggaagctgttggctgaaaaggtggtctatgttggcgtctggatccc tgccctcctgctgactattcccgacttcatctttgccaacgtcagtgagg cagatgacagatatatctgtgaccgcttctaccccaatgacttgtgggtg gttgtgttccagtttcagcacatcatggttggccttatcctgcctggtat tgtcatcctgtcctgctattgcattatcatctccaagctgtcacactcca agggccaccagaagcgcaaggccctcaagaccacagtcatcctcatcctg gctttcttcgcctgttggctgccttactacattgggatcagcatcgactc cttcatcctcctggaaatcatcaagcaaggggtgtgagtttgagaacactg tgcacaagtggatttccatcaccgaggccctagctttcttccactgttgt ctgaaccccatcctctatgctttccttggagccaaatttaaaacctctgc ccagcacgcactcacctctgtgagcagagggtccagcctcaagatcctct
```

```
ccaaaggaaagcgaggtggacattcatctgtttccactgagtctgagtct tcaagttttcactccagctaa
```

The protein and cDNA sequences for mature human CCR5 are shown below.

```
Mature Human CCR5 Protein
                                          (SEQ ID NO: 59)
mdyqvsspiy dinyytsepc qkinvkqiaa rllpplyslv fifgfvgnml vililinckr lksmtdiyll nlaisdlffl ltvpfwahya aaqwdfgntm cqlltglyfi gffsgiffii lltidrylav vhavfalkar tvtfgvvtsv itwvvavfas lpgiiftrsq keglhytcss hfpysqyqfw knfqtlkivi lglvlpllvm vicysgilkt llrcrnekkr hravrlifti mivyflfwap ynivllltf qeffglnncs ssnrldqamq vtetlgmthc cinpiiyafv gekfrnyllv ffqkhiakrf ckccsifqqe aperassvyt rstgegeisv gl
```

```
Human CCR5 cDNA
                                          (SEQ ID NO: 60)
atggattatcaagtgtcaagtccaatctatgacatcaattattatacatc ggagccctgccaaaaaatcaatgtgaagcaaatcgcagcccgcctcctgc ctccgctctactcactggtgttcatctttggttttgtgggcaacatgctg gtcatcctcatcctgataaactgcaaaaggctgaagagcatgactgacat ctacctgctcaacctggccatctctgacctgttttttccttcttactgtcc ccttctgggctcactatgctgccgcccagtgggactttggaaatacaatg tgtcaactcttgacagggctctattttataggcttcttctctggaatctt cttcatcatcctcctgacaatcgataggtacctggctgtcgtccatgctg tgtttgctttaaaagccaggacggtcacctttggggtggtgacaagtgtg atcacttgggtggtggctgtgtttgcgtctctcccaggaatcatctttac cagatctcaaaaagaaggtcttcattacacctgcagctctcattttccat acagtcagtatcaattctggaagaatttccagacattaaagatagtcatc ttggggctggtcctgccgctgcttgtcatggtcatctgctactcgggaat cctaaaaactctgcttcggtgtcgaaatgagaagaagaggcacagggctg tgaggcttatcttcaccatcatgattgtttattttctcttctgggctccc tacaacattgtccttctcctgaacaccttccaggaattctttggcctgaa taattgcagtagctctaacaggttggaccaagctatgcaggtgacagaga ctcttgggatgacgcactgctgcatcaacccatcatctatgcctttgtc ggggagaagttcagaaactacctcttagtcttcttccaaaagcacattgc caaacgcttctgcaaatgctgttctattttccagcaagaggctcccgagc
``` gagcaagctcagtttacacccgatccactggggagcaggaaatatctgtg ggcttgtga

The protein and cDNA sequences for mature human S1P5 are shown below.

Mature Human S1P5 Protein
(SEQ ID NO: 61)
mesgllrpap vsevivlhyn ytgklrgary qpgaglrada vvclavcafi vlenlavllv lgrhprfhap mflllgsltl sdllagaaya anillsgplt lklspalwfa reggvfvalt asvlsllaia lersltmarr gpapvssrgr tlamaaaawg vslllgllpa lgwnclgrld acstvlplya kayvlfcvla fvgilaaica lyariycqvr anarrlparp gtagttstra rrkprslall rtlsvvllaf vacwgplfll llldvacpar tcpvllqadp flglamansl lnpiiytltn rdlrhallrl vccgrhscgr dpsgsqqsas aaeasgglrr clppgldgsf sgsersspqr dgldtsgstg spgaptaart lvsepaad Human S1P5 cDNA
(SEQ ID NO: 62)
atggagtcggggctgctgcggccggcgccggtgagcgaggtcatcgtcct gcattacaactacaccggcaagctccgcggtgcgcgctaccagccgggtg ccggcctgcgcgccgacgccgtggtgtgcctggcggtgtgcgccttcatc gtgctagagaatctagccgtgttgttggtgctcggacgccacccgcgctt ccacgctcccatgttcctgctcctgggcagcctcacgttgtcggatctgc tggcaggcgccgcctacgccgccaacatcctactgtcggggccgctcacg ctgaaactgtcccccgcgctctggttcgcacgggagggaggcgtcttcgt ggcactcactgcgtccgtgctgagcctcctggccatcgcgctggagcgca gcctcaccatggcgcgcaggggggcccgcgccgtctccagtcggggcgc acgctggcgatggcagccgcggcctggggcgtgtcgctgctcctcgggct cctgccagcgctgggctggaattgcctgggtcgcctggacgcttgctcca ctgtcttgccgctctacgccaaggcctacgtgctcttctgcgtgctcgcc ttcgtgggcatcctggccgctatctgtgcactctacgcgcgcatctactg ccaggtacgcgccaacgcgcggcgcctgccggcacggcccgggactgcgg ggaccacctcgacccgggcgcgtcgcaagccgcgctcgctggccttgctg cgcacgctcagcgtggtgctcctggccttttgtggcatgttggggcccct cttcctgctgctgttgctcgacgtggcgtgcccggcgcgcacctgtcctg tactcctgcaggccgatcccttcctgggactggccatggccaactcactt ctgaacccatcatctacacgcttcaccaaccgcgacctgcgccacgcgct cctgcgcctggtctgctgcgcggacgccactcctgcggcagagacccgagtg gctcccagcagtcggcgagcgcggctgaggcttccggggggcctgcgccgc tgcctgcccccgggccttgatgggagcttcagcggctcggagcgctcatc The protein and cDNA sequences for mature human C-kit are shown below.

Mature Human C-kit Protein
(SEQ ID NO: 63)
qpsvs pgepsppsih pgksdlivrv gdeirllctd pgfvkwtfei ldetnenkqn ewitekaeat ntgkytctnk hglsnsiyvf vrdpaklflv drslygkedn dtlvrcpltd pevtnyslkg cqgkplpkdl rfipdpkagi miksvkrayh rlclhcsvdq egksvlsekf ilkvrpafka vpvvsvskas yllregeeft vtctikdvss svystwkren sqtklqekyn swhhgdfnye rqatltissa rvndsgvfmc yanntfgsan vtttlevvdk gfinifpmin ttvfvndgen vdliveyeaf pkpehqqwiy mnrtftdkwe dypksenesn iryvselhlt rlkgteggty tflvsnsdvn aaiafnvyvn tkpeiltydr lvngmlqcva agfpeptidw yfcpgteqrc sasvlpvdvq tlnssgppfg klvvqssids safkhngtve ckayndvgkt sayfnfafkg nnkeqihpht lftplligfv ivagmmciiv miltykylqk pmyevqwkvv eeingnnyvy idptqlpydh kwefprnrls fgktlgagaf gkvveatayg liksdaamtv avkmlkpsah ltererealmse lkvlsylgnh mnivnllgac tiggptlvit eyccygdlln flrrkrdsfi cskqedhaea alyknllhsk esscsdstne ymdmkpgvsy vvptkadkrr svrigsyier dvtpaimedd elaldledll sfsyqvakgm aflaskncih rdlaarnill thgritkicd fglardiknd snyvvkgnar lpvkwmapes ifncvytfes dvwsygiflw elfslgsspy pgmpvdskfy kmikegfrml spehapaemy dimktcwdad plkrptfkqi vqliekqise stnhiysnla ncspnrqkpv vdhsvrinsv gstasssqpl lvhddv Human C-kit cDNA
(SEQ ID NO: 64)
atgagaggcgctcgcggcgcctgggattttctctgcgttctgctcctact gcttcgcgtccagacaggctcttctcaaccatctgtgagtccaggggaac cgtctccaccatccatccatccaggaaaatcagacttaatagtccgcgtg ggcgacgagattaggctgttatgcactgatccgggctttgtcaaatggac ttttgagatcctggatgaaacgaatgagaataagcagaatgaatggatca cggaaaaggcagaagccaccaacaccggcaaatacgtgcaccaacaaa cacggcttaagcaattccatttatgtgtttgttagagatcctgccaagct tttccttgttgaccgctccttgtatgggaagaagacaacgacacgctgg tccgctgtcctctcacagacccagaagtgaccaattattccctcaagggg tgccaggggaagcctcttcccaaggacttgaggtttattcctgacccaa -continued

```
ggcgggcatcatgatcaaaagtgtgaaacgcgcctaccatcggctctgtc
tgcattgttctgtggaccaggagggcaagtcagtgctgtcggaaaaattc
atcctgaaagtgaggccagccttcaaagctgtgcctgttgtgtctgtgtc
caaagcaagctatcttcttagggaaggggaagaattcacagtgacgtgca
caataaaagatgtgtctagttctgtgtactcaacgtggaaaagagaaaac
agtcagactaaactacaggagaaatataatagctggcatcacggtgactt
caattatgaacgtcaggcaacgttgactatcagttcagcgagagttaatg
attctggagtgttcatgtgttatgccaataatacttttggatcagcaaat
gtcacaacaaccttggaagtagtagataaaggattcattaatatcttccc
catgataaacactacagtatttgtaaacgatggagaaaatgtagatttga
ttgttgaatatgaagcattccccaaacctgaacaccagcagtggatctat
atgaacagaaccttcactgataaatgggaagattatcccaagtctgagaa
tgaaagtaatatcagatacgtaagtgaacttcatctaacgagattaaaag
gcaccgaaggaggcacttacacattcctagtgtccaattctgacgtcaat
gctgccatagcatttaatgtttatgtgaatacaaaaccagaaatcctgac
ttacgacaggctcgtgaatggcatgctccaatgtgtggcagcaggattcc
cagagcccacaatagattggtattttgtccaggaactgagcagagatgc
tctgcttctgtactgccagtggatgtgcagacactaaactcatctgggcc
accgtttggaaagctagtggttcagagttctatagattctagtgcattca
agcacaatggcacggttgaatgtaaggcttacaacgatgtgggcaagact
tctgcctattttaactttgcatttaaaggtaacaacaaagagcaaatcca
tccccacaccctgttcactcctttgctgattggtttcgtaatcgtagctg
gcatgatgtgcattattgtgatgattctgacctacaaatatttacagaaa
cccatgtatgaagtacagtggaaggttgttgaggagataaatggaaacaa
ttatgtttacatagacccaacacaacttccttatgatcacaaatgggagt
```

-continued

```
ttcccagaaacaggctgagttttgggaaaaccctgggtgctggagctttc
gggaaggttgttgaggcaactgcttatggcttaattaagtcagatgcggc
catgactgtcgctgtaaagatgctcaagccgagtgcccatttgacagaac
gggaagccctcatgtctgaactcaaagtcctgagttaccttggtaatcac
atgaatattgtgaatctacttggagcctgcaccattggagggcccaccct
ggtcattacagaatattgttgctatggtgatctttgaattttttgagaa
gaaaacgtgattcatttatttgttcaaagcaggaagatcatgcagaagct
gcactttataagaatcttctgcattcaaaggagtcttcctgcagcgatag
tactaatgagtacatggacatgaaacctggagtttcttatgttgtcccaa
ccaaggccgacaaaaggagatctgtgagaataggctcatacatagaaga
gatgtgactcccgccatcatggaggatgacgagttggccctagacttaga
agacttgctgagcttttcttaccaggtggcaaagggcatggctttcctcg
cctccaagaattgtattcacagagacttggcagccagaaatatcctcctt
actcatggtcggatcacaaagatttgtgattttggtctagccagagacat
caagaatgattctaattatgtggttaaaggaaacgctcgactacctgtga
agtggatggcacctgaaagcatttttcaactgtgtatacacgtttgaaagt
gacgtctggtcctatgggattttttctttgggagctgttctctttaggaag
cagcccctatcctggaatgccggtcgattctaagttctacaagatgatca
aggaaggcttccggatgctcagccctgaacacgcacctgctgaaatgtat
gacataatgaagacttgctgggatgcagatcccctaaaaagaccaacatt
caagcaaattgttcagctaattgagaagcagatttcagagagcaccaatc
atatttactccaacttagcaaactgcagccccaaccgacagaagcccgtg
gtagaccattctgtgcggatcaattctgtcggcagcaccgcttcctcctc
ccagcctctgcttgtgcacgacgatgtctga
```

The protein and cDNA sequences for mature human mTOR are shown below.

```
Mature Human mTOR Protein
                                              (SEQ ID NO: 65)
mlgtgpaaat taattssnvs vlqqfasglk srneetraka akelqhyvtm elremsqees
trfydqlnhh ifelvsssda nerkggilai asligveggn atrigrfany lrnllpsndp
vvmemaskai grlamagdtf taeyvefevk ralewlgadr negrrhaavl vlrelaisvp
tfffqvqpf fdnifvavwd pkqairegav aalraclilt tqrepkemqk pqwyrhtfee
aekgfdetla kekgmnrddr ihgallilne lvrissmege rlreemeeit qqqlvhdkyc
kdlmgfgtkp rhitpftsfq avqpqqsnal vgllgysshq glmgfgtsps pakstlvesr
ccrdlmeekf dqvcqwvlkc rnsknsliqm tilnllprla afrpsaftdt qylqdtmnhv
lscvkkeker taafqalgll svavrsefkv ylprvldiir aalppkdfah krqkamqvda
tvftcismla ramgpgiqqd ikellepmla vglspaltav lydlsrqipq lkkdiqdgll
kmlslvlmhk plrhpgmpkg lahqlaspgl ttlpeasdvg sitlalrtlg sfefeghslt
qfvrhcadhf lnsehkeirm eaartcsrll tpsihlisgh ahvvsqtavq vvadvlskll
vvgitdpdpd irycvlasld erfdahlaqa enlqalfval ndqvfeirel aictvgrlss
mnpafvmpfl rkmliqilte lehsgigrik eqsarmlghl vsnaprlirp ymepilkali
```

-continued lklkdpdpdp npgvinnvla tigelaqvsg lemrkwvdel fiiimdmlqd ssllakrqva lwtlgqlvas tgyvvepyrk yptllevlin flkteqnqgt rreairvlgl lgaldpykhk vnigmidqsr dasavslses kssqdssdys tsemlvnmgn lpldefypav smvalmrifr dqslshhhtm vvqaitfifk slglkcvqfl pqvmptflnv irvcdgaire flfqqlgmlv sfvkshirpy mdeivtlmre fwvmntsiqs tiillieqiv valggefkly lpqliphmlr vfmhdnspgr ivsikllaai qlfganlddy lhlllppivk lfdapeaplp srkaaletvd rltesldftd yasriihpiv rtldqspelr stamdtlssl vfqlgkkyqi fipmvnkvlv rhrinhqryd vlicrivkgy tladeeedpl iyqhrmlrsg qgdalasgpv etgpmkklhv stinlqkawg aarrvskddw lewlrrlsle llkdssspsl rscwalaqay npmardlfna afvscwseln edqqdelirs ielaltsqdi aevtqtllnl aefmehsdkg plplrddngi vllgeraakc rayakalhyk elefqkgptp aileslisin nklqqpeaaa gvleyamkhf geleiqatwy eklhewedal vaydkkmdtn kddpelmlgr mrclealgew gqlhqqccek wtlvndetqa kmarmaaaaa wglgqwdsme eytcmiprdt hdgafyravl alhqdlfsla qqcidkardl ldaeltamag esysraygam vschmlsele eviqyklvpe rreiirqiww erlqgcqriv edwqkilmvr slvvsphedm rtwlkyaslc gksgrlalah ktlvlllgvd psrqldhplp tvhpqvtyay mknmwksark idafqhmqhf vqtmqqqaqh aiatedqqhk qelhklmarc flklgewqln lqginestip kvlqyysaat ehdrswykaw hawavmnfea vlhykhqnga rdekkklrha sganitnatt aattaatatt tastegsnse seaestensp tpsplqkkvt edlsktllmy tvpavqgffr sislsrgnnl qdtlrvltlw fdyghwpdvn ealvegvkai qidtwlqvip qliaridtpr plvgrlihql ltdigryhpq aliypltvas kstttarhna ankilknmce hsntlvqqam mvseelirva ilwhemwheg leeasrlyfg ernvkgmfev leplhammer gpqtlketsf ngaygrdlme aqewcrkymk sgnvkdltqa wdlyyhvfrr iskqlpqlts lelqyvspkl lmcrdlelav pgtydpnqpi iriqsiapsl qvitskqrpr kltlmgsngh efvillkghe dlrqdervmq lfglvntlla ndptslrknl siqryavipl stnsgligwv phcdtlhali rdyrekkkil lniehrimlr mapdydhltl mqkvevfeha vnntagddla kllwlkspss evwfdrrtny trslavmsmv gyilglgdrh psnlmldrls gkilhidfgd cfevamtrek fpekipfrlt rmltnamevt gldgnyritc htvmevlreh kdsvmavlea fvydpllnwr lmdtntkgnk rsrtrtdsys agqsveildg velgepahkk tgttvpesih sfigdglvkp ealnkkaiqi inrvrdkltg rdfshddtld vptqvellik qatshenlcq cyigwcpfw Human mTOR cDNA (SEQ ID NO: 66)

atgcttgga accggacctg ccgccgccac caccgctgcc accacatcta gcaatgtgag cgtcctgcag cagtttgcca gtggcctaaa gagccggaat gaggaaacca gggccaaagc cgccaaggag ctccagcact atgtcaccat ggaactccga gagatgagtc aagaggagtc tactcgcttc tatgaccaac tgaaccatca catttttgaa ttggtttcca gctcagatgc caatgagagg aaaggtggca tcttggccat agctagcctc ataggagtgg aaggtgggaa tgccacccga attggcagat ttgccaacta tcttcggaac ctcctcccct ccaatgaccc agttgtcatg gaaatggcat ccaaggccat tggccgtctt gccatggcag gggacacttt taccgctgag tacgtggaat ttgaggtgaa gcgagccctg gaatggctgg gtgctgaccg caatgagggc cggagacatg cagctgtcct ggttctccgt gagctggcca tcagcgtccc -continued

```
taccttcttc ttccagcaag tgcaacccct ctttgacaac attttgtgg ccgtgtggga ccccaaacag gccatccgtg agggagctgt agccgccctt cgtgcctgtc tgattctcac aacccagcgt gagccgaagg agatgcagaa gcctcagtgg tacaggcaca catttgaaga agcagagaag ggatttgatg agaccttggc caaagagaag ggcatgaatc gggatgatcg gatccatgga gccttgttga tccttaacga gctggtccga atcagcagca tggagggaga gcgtctgaga gaagaaatgg aagaaatcac acagcagcag ctggtacacg acaagtactg caaagatctc atgggcttcg gaacaaaacc tcgtcacatt acccccttca ccagtttcca ggctgtacag ccccagcagt caaatgcctt ggtggggctg ctggggtaca gctctcacca aggcctcatg ggatttggga cctcccccag tccagctaag tccaccctgg tggagagccg gtgttgcaga gacttgatgg aggagaaatt tgatcaggtg tgccagtggg tgctgaaatg caggaatagc aagaactcgc tgatccaaat gacaatcctt aatttgttgc cccgcttggc tgcattccga ccttctgcct tcacagatac ccagtatctc caagatacca tgaaccatgt cctaagctgt gtcaagaagg agaaggaacg tacagcggcc ttccaagccc tggggctact ttctgtggct gtgaggtctg agtttaaggt ctatttgcct cgcgtgctgg acatcatccg agcggccctg cccccaaagg acttcgccca taagaggcag aaggcaatgc aggtggatgc cacagtcttc acttgcatca gcatgctggc tcgagcaatg gggccaggca tccagcagga tatcaaggag ctgctggagc ccatgctggc agtgggacta agccctgccc tcactgcagt gctctacgac ctgagccgtc agattccaca gctaaagaag gacattcaag atgggctact gaaaatgctg tccctggtcc ttatgcacaa acccctccgc cacccaggca tgcccaaggg cctggcccat cagctggcct ctcctggcct cacgaccctc cctgaggcca gcgatgtggg cagcatcact cttgccctcc gaacgcttgg cagctttgaa tttgaaggcc actctctgac ccaatttgtt cgccactgtg cggatcattt cctgaacagt gagcacaagg agatccgcat ggaggctgcc cgcacctgct cccgcctgct cacaccctcc atccacctca tcagtggcca tgctcatgtg gttagccaga ccgcagtgca agtggtggca gatgtgctta gcaaactgct cgtagttggg ataacagatc ctgaccctga cattcgctac tgtgtcttgg cgtccctgga cgagcgcttt gatgcacacc tggcccaggc ggagaacttg caggccttgt tgtggctct gaatgaccag gtgtttgaga tccgggagct ggccatctgc actgtgggcc gactcagtag catgaaccct gcctttgtca tgcctttcct gcgcaagatg ctcatccaga ttttgacaga gttggagcac agtgggattg gaagaatcaa agagcagagt gcccgcatgc tggggcacct ggtctccaat gcccccgac tcatccgccc ctacatggag cctattctga aggcattaat tttgaaactg aaagatccag accctgatcc aaacccaggt gtgatcaata atgtcctggc aacaatagga gaattggcac aggttagtgg cctggaaatg aggaaatggg ttgatgaact ttttattatc atcatggaca tgctccagga ttcctctttg ttggccaaaa ggcaggtggc tctgtggacc ctgggacagt tggtggccag cactggctat gtagtagagc cctacaggaa gtaccctact ttgcttgagg tgctactgaa ttttctgaag actgagcaga accagggtac acgcagagag gccatccgtg tgttagggct tttaggggct ttggatcctt acaagcacaa agtgaacatt ggcatgatag accagtcccg ggatgcctct gctgtcagcc tgtcagaatc caagtcaagt caggattcct ctgactatag cactagtgaa atgctggtca acatgggaaa cttgcctctg gatgagttct acccagctgt gtccatggtg ccctgatgc ggatcttccg agaccagtca ctctctcatc atcacaccat ggttgtccag gccatcacct tcatcttcaa gtccctggga ctcaaatgtg tgcagttcct gccccaggtc atgcccacgt tccttaacgt
```

-continued

```
cattcgagtc tgtgatgggg ccatccggga attttgttc cagcagctgg gaatgttggt
gtcctttgtg aagagccaca tcagaccta tatggatgaa atagtcaccc tcatgagaga
attctgggtc atgaacacct caattcagag cacgatcatt cttctcattg agcaaattgt
ggtagctctt gggggtgaat ttaagctcta cctgccccag ctgatcccac acatgctgcg
tgtcttcatg catgacaaca gcccaggccg cattgtctct atcaagttac tggctgcaat
ccagctgttt ggcgccaacc tggatgacta cctgcattta ctgctgcctc ctattgttaa
gttgtttgat gcccctgaag ctccactgcc atctcgaaag gcagcgctag agactgtgga
ccgcctgacg gagtccctgg atttcactga ctatgcctcc cggatcattc accctattgt
tcgaacactg gaccagagcc cagaactgcg ctccacagcc atggacacgc tgtcttcact
tgttttcag ctggggaaga agtaccaaat tttcattcca atggtgaata agttctggt
gcgacaccga atcaatcatc agcgctatga tgtgctcatc tgcagaattg tcaagggata
cacacttgct gatgaagagg aggatccttt gatttaccag catcggatgc ttaggagtgg
ccaaggggat gcattggcta gtggaccagt ggaaacagga cccatgaaga aactgcacgt
cagcaccatc aacctccaaa aggcctgggg cgctgccagg agggtctcca agatgactg
gctggaatgg ctgagacggc tgagcctgga gctgctgaag gactcatcat cgccctccct
gcgctcctgc tgggccctgg cacaggccta aacccgatg ccagggatc tcttcaatgc
tgcatttgtg tcctgctggt ctgaactgaa tgaagatcaa caggatgagc tcatcagaag
catcgagttg gccctcacct cacaagacat cgctgaagtc acacagaccc tcttaaactt
ggctgaattc atggaacaca gtgacaaggg cccctgcca ctgagagatg acaatggcat
tgttctgctg ggtgagagag ctgccaagtg ccgagcatat gccaaagcac tacactacaa
agaactggag ttccagaaag gccccacccc tgccattcta gaatctctca tcagcattaa
taataagcta cagcagccgg aggcagcggc cggagtgtta aatatgcca tgaaacactt
tggagagctg gagatccagg ctacctggta tgagaaactg cacgagtggg aggatgccct
tgtggcctat gacaagaaaa tggacaccaa caaggacgac ccagagctga tgctgggccg
catgcgctgc ctcgaggcct tgggggaatg gggtcaactc caccagcagt gctgtgaaaa
gtggaccctg gttaatgatg agacccaagc caagatggcc cggatggctg ctgcagctgc
atggggttta ggtcagtggg acagcatgga agaatacacc tgtatgatcc ctcgggacac
ccatgatggg gcattttata gagctgtgct ggcactgcat caggacctct tctccttggc
acaacagtgc attgacaagg ccagggacct gctggatgct gaattaactg cgatggcagg
agagagttac agtcgggcat atggggccat ggtttcttgc cacatgctgt ccgagctgga
ggaggttatc cagtacaaac ttgtccccga gcgacgagag atcatccgcc agatctggtg
ggagagactg cagggctgcc agcgtatcgt agaggactgg cagaaaatcc ttatggtgcg
gtcccttgtg gtcagccctc atgaagacat gagaacctgg ctcaagtatg caagcctgtg
cggcaagagt ggcaggctgg ctcttgctca taaaacttta gtgttgctcc tgggagttga
tccgtctcgg caacttgacc atcctctgcc aacagttcac cctcaggtga cctatgccta
catgaaaaac atgtggaaga gtgcccgcaa gatcgatgcc ttccagcaca tgcagcattt
tgtccagacc atgcagcaac aggcccagca tgccatcgct actgaggacc agcagcataa
gcaggaactg cacaagctca tggcccgatg cttcctgaaa cttggagagt ggcagctgaa
tctacagggc atcaatgaga gcacaatccc caaagtgctg cagtactaca gcgccgccac
agagcacgac cgcagctggt acaaggcctg gcatgcgtgg gcagtgatga acttcgaagc
```

-continued

```
tgtgctacac tacaaacatc agaaccaagc ccgcgatgag aagaagaaac tgcgtcatgc cagcggggcc aacatcacca acgccaccac tgccgccacc acggccgcca ctgccaccac cactgccagc accgagggca gcaacagtga gagcgaggcc gagagcaccg agaacagccc caccccatcg ccgctgcaga agaaggtcac tgaggatctg tccaaaaccc tcctgatgta cacggtgcct gccgtccagg gcttcttccg ttccatctcc ttgtcacgag caacaacct ccaggataca ctcagagttc tcaccttatg gtttgattat ggtcactggc cagatgtcaa tgaggcctta gtggaggggg tgaaagccat ccagattgat acctggctac aggttatacc tcagctcatt gcaagaattg atacgcccag acccttggtg ggacgtctca ttcaccagct tctcacagac attggtcggt accacccca ggccctcatc tacccactga cagtggcttc taagtctacc acgacagccc ggcacaatgc agccaacaag attctgaaga acatgtgtga gcacagcaac accctggtcc agcaggccat gatggtgagc gaggagctga tccgagtggc catcctctgg catgagatgt ggcatgaagg cctggaagag gcatctcgtt tgtactttgg ggaaaggaac gtgaaaggca tgtttgaggt gctggagccc ttgcatgcta tgatggaacg gggcccccag actctgaagg aaacatcctt taatcaggcc tatggtcgag atttaatgga ggcccaagag tggtgcagga agtacatgaa atcagggaat gtcaaggacc tcacccaagc ctgggacctc tattatcatg tgttccgacg aatctcaaag cagctgcctc agctcacatc cttagagctg caatatgttt ccccaaaact tctgatgtgc cgggaccttg aattggctgt gccaggaaca tatgaccca accagccaat cattcgcatt cagtccatag caccgtcttt gcaagtcatc acatccaagc agaggccccg gaaattgaca cttatgggca gcaacggaca tgagtttgtt ttccttctaa aaggccatga agatctgcgc caggatgagc gtgtgatgca gctcttcggc ctggttaaca cccttctggc caatgaccca acatctcttc ggaaaaaacct cagcatccag agatacgctg tcatcccttt atcgaccaac tcgggcctca ttggctgggt tccccactgt gacacactgc acgccctcat ccgggactac agggagaaga agaagatcct tctcaacatc gagcatcgca tcatgttgcg gatggctccg gactatgacc acttgactct gatgcagaag gtggaggtgt ttgagcatgc cgtcaataat acagctgggg acgacctggc caagctgctg tggctgaaaa gccccagctc cgaggtgtgg tttgaccgaa gaaccaatta tacccgttct ttagcggtca tgtcaatggt tgggtatatt ttaggcctgg gagatagaca cccatccaac ctgatgctgg accgtctgag tgggaagatc ctgcacattg actttgggga ctgctttgag gttgctatga cccgagagaa gtttccagag aagattccat ttagactaac aagaatgttg accaatgcta tggaggttac aggcctggat ggcaactaca gaatcacatg ccacacagtg atggaggtgc tgcgagagca caaggacagt gtcatggccg tgctggaagc ctttgtctat gaccccttgc tgaactggag gctgatggac acaaatacca aggcaacaa gcgatcccga acgaggacgg attcctactc tgctggccag tcagtcgaaa ttttggacgg tgtggaactt ggagagccag cccataagaa acgggggacc acagtgccag aatctattca ttctttcatt ggagacggtt tggtgaaacc agaggcccta aataagaaag ctatccagat tattaacagg gttcgagata agctcactgg tcgggacttc tctcatgatg acactttgga tgttccaacg caagttgagc tgctcatcaa acaagcgaca tcccatgaaa acctctgcca gtgctatatt ggctggtgcc ctttctggtg a
```

Non-limiting examples of commercial ELISA assays that can be used to determine the expression level of SREBP1 are available from Novus Biologicals and Abcam. The protein and cDNA sequences for mature human SREBP1 are shown below.

```
Mature Human SREBP1 Protein
                                            (SEQ ID NO: 67)
MDEPPFSEAALEQALGEPCDLDAALLTDIEDMLQLINNQDSDFPGLFDPP

YAGSGAGGTDPASPDTSSPGSLSPPPATLSSSLEAFLSGPQAAPSPLSPP

QPAPTPLKMYPSMPAFSPGPGIKEESVPLSILQTPTPQPLPGALLPQSFP

APAPPQFSSTPVLGYPSPPGGFSTGSPPGNTQQPLPGLPLASPPGVPPVS

LHTQVQSVVPQQLLTVTAAPTAAPVTTTVTSQIQQVPVLLQPHFIKADSL

LLTAMKTDGATVKAAGLSPLVSGTTVQTGPLPTLVSGGTILATVPLVVDA

EKLPINRLAAGSKAPASAQSRGEKRTAHNAIEKRYRSSINDKIIELKDLV

VGTEAKLNKSAVLRKAIDYIRFLQHSNQKLKQENLSLRTAVHKSKSLKDL

VSACGSGGNTDVLMEGVKTEVEDTLTPPPSDAGSPFQSSPLSLGSRGSGS

GGSGSDSEPDSPVFEDSKAKPEQRPSLHSRGMLDRSRLALCTLVFLCLSC

NPLASLLGARGLPSPSDTTSVYHSPGRNVLGTESRDGPGWAQWLLPPVVW

LLNGLLVLVSLVLLFVYGEPVTRPHSGPAVYFWRHRKQADLDLARGDFAQ

AAQQLWLALRALGRPLPTSHLDLACSLLWNLIRHLLQRLWVGRWLAGRAG

GLQQDCALRVDASASARDAALVYHKLHQLHTMGKHTGGHLTATNLALSAL

NLAECAGDAVSVATLAEIYVAAALRVKTSLPRALHFLTRFFLSSARQACL

AQSGSVPPAMQWLCHPVGHRFFVDGDWSVLSTPWESLYSLAGNPVDPLAQ

VTQLFREHLLERALNCVTQPNPSPGSADGDKEFSDALGYLQLLNSCSDAA

GAPAYSFSISSSMATTTGVDPVAKWWASLTAVVIHWLRRDEEAAERLCPL

VEHLPRVLQESERPLPRAALHSFKAARALLGCAKAESGPASLTICEKASG

YLQDSLATTPASSSIDKAVQLFLCDLLLVVRTSLWRQQQPPAPAPAAQGT

SSRPQASALELRGFQRDLSSLRRLAQSFRPAMRRVFLHEATARLMAGASP

TRTHQLLDRSLRRRAGPGGKGGAVAELEPRPTRREHAEALLLASCYLPPG

FLSAPGQRVGMLAEAARTLEKLGDRRLLHDCQQMLMRLGGGTTVTSS

Human SREBP1 cDNA
                                            (SEQ ID NO: 68)
atggacgagccacccttcagcgaggcggctttggagcaggcgctgggcga gccgtgcgatctggacgcggcgctgctgaccgacatcgaagacatgcttc agcttatcaacaaccaagacagtgacttccctggcctatttgacccaccc tatgctgggagtggggcaggggcacagaccctgccagccccgataccag ctccccaggcagcttgtctccacctcctgccacattgagctcctctcttg aagccttcctgagcgggccgcaggcagcgccctcacccctgtccctccc cagcctgcacccactccattgaagatgtaccgtccatgcccgctttctc ccctgggcctggtatcaaggaagagtcagtgccactgagcatcctgcaga cccccacccacagccctgccaggggccctcctgccacagagcttccca gcccagccccaccgcagttcagctccacccctgtgttaggctaccccag ccctccgggaggcttctctacaggaagccctcccgggaacacccagcagc cgctgcctggcctgccactggcttccccgccaggggtcccgcccgtctcc ttgcacacccaggtccagagtgtggtcccccagcagctactgacagtcac agctgcccccacggcagcccctgtaacgaccactgtgacctcgcagatcc agcaggtcccggtcctgctgcagcccacttcatcaaggcagactcgctg cttctgacagccatgaagacagacggagccactgtgaaggcggcaggtct cagtcccctggtctctggcaccactgtgcagacagggcctttgccgaccc tggtgagtggcggaaccatcttggcaacagtcccactggtcgtagatgcg gagaagctgcctatcaaccggctcgcagctggcagcaaggccccggcctc tgcccagagccgtggagagaagcgcacgcccacaacgccattgagaagc gctaccgctcctccatcaatgacaaaatcattgagctcaaggatctggtg gtgggcactgaggcaaagctgaataaatctgctgtcttgcgcaaggccat cgactacattcgctttctgcaacacagcaaccagaaactcaagcaggaga acctaagtctgcgcactgctgtccacaaaagcaaatctctgaaggatctg gtgtcggcctgtgcagtggagggaacacagacgtgctcatggagggcgt gaagactgaggtggaggacacactgaccccaccccctcggatgctggct caccttccagagcagccccttgtcccttggcagcaggggcagtggcagc ggtggcagtggcagtgactcggagcctgacagcccagtctttgaggacag caaggcaaagccagagcagcggccgtctctgcacagccggggcatgctgg accgctcccgcctggccctgtgcacgctcgtcttcctctgcctgtcctgc aaccccttggcctccttgctgggggcccgggggcttcccagcccctcaga taccaccagcgtctaccatagccctgggcgcaacgtgctgggcaccgaga gcagagatggccctggctgggcccagtggctgctgccccagtggtctgg ctgctcaatgggctgttggtgctcgtctccttggtgcttctctttgtcta cggtgagccagtcacacggccccactcaggccccgccgtgtacttctgga ggcatcgcaagcaggctgacctggacctggcccggggagactttgcccag gctgcccagcagctgtggctggccctgcgggcactgggccggcccctgcc cacctcccacctggacctggcttgtagcctcctctggaacctcatccgtc acctgctgcagcgtctctgggtgggccgctggctggcaggccgggcaggg ggcctgcagcaggactgtgctctgcgagtggatgctagcgccagcgcccg agacgcagccctggtctaccataagctgcaccagctgcacaccatgggga agcacacaggcgggcacctcactgccaccaacctggcgctgagtgccctg aacctggcagagtgtgcagggatgccgtgtctgtggcgacgctggccga gatctatgtggcggctgcattgagagtgaagaccagtctcccacgggcct tgcattttctgacacgcttcttcctgagcagtgcccgccaggcctgcctg gcacagagtggctcagtgcctcctgccatgcagtggctctgccaccccgt gggccaccgtttcttcgtggatggggactggtccgtgctcagtaccccat gggagagcctgtacagcttggcccggaacccagtggaccccctggcccag gtgactcagctattccgggaacatctcttagagcgagcactgaactgtgt gacccagcccaacccagccctgggtcagctgatggggcaaggaattct cggatgccctcgggtacctgcagctgctgaacagctgttctgatgctgcg ggggctcctgcctacagcttctccatcagttccagcatggccaccaccac cggcgtagaccccggtggccaagtggtgggcctctctgacagctgtggtga
```

```
tccactggctgcggcgggatgaggaggcggctgagcggctgtgcccgctg gtggagcacctgccccgggtgctgcaggagtctgagagaccoctgcccag ggcagctctgcactccttcaaggctgcccgggccctgctgggctgtgcca aggcagagtctggtccagccagcctgaccatctgtgagaaggccagtggg tacctgcaggacagcctggctaccacaccagccagcagctccattgacaa ggccgtgcagctgttcctgtgtgacctgcttcttgtggtgcgcaccagcc tgtggcggcagcagcagcccccggccccggcccagcagcccagggcacc agcagcaggccccaggcttccgcccttgagctgcgtggcttccaacggga cctgagcagcctgaggcggctggcacagagcttccggcccgccatgcgga gggtgttcctacatgaggccacggcccggctgatggcggggggccagccc acacggacacaccagctcctcgaccgcagtctgaggcggcgggcaggccc cggtggcaaaggaggcgcggtggcggagctggagccgcggcccacgcggc gggagcacgcggaggccttgctgctggcctcctgctacctgcccccggc ttcctgtcggcgcccgggcagcgcgtgggcatgctggctgaggcggcgcg cacactcgagaagcttggcgatcgccggctgctgcacgactgtcagcaga tgctcatgcgcctgggcggtgggaccactgtcacttccagctag
```

Non-limiting examples of commercial ELISA assays that can be used to determine the expression level of IFN-γ are available from R&D Systems, Thermo Fisher Scientific, Abcam, Enzo Life Sciences, and RayBiotech. The protein and cDNA sequences for mature human IFN-γ are shown below.

```
Mature Human IFN-γ
                                    (SEQ ID NO: 69)
qdpyvke aenlkkyfna ghsdvadngt lflgilknwk eesdrkimqs qivsfyfklf knfkddqsiq ksvetikedm nvkffnsnkk krddfekltn ysvtdlnvqr kaiheliqvm aelspaaktg krkrsqmlfr g Human IFN-γ cDNA
                                    (SEQ ID NO: 70)
caggac ccatatgtaa agaagcaga aaaccttaag aaatatttta atgcaggtca ttcagatgta gcggataatg gaactctttt cttaggcatt ttgaagaatt ggaaagagga gagtgacaga aaaataatgc agagccaaat tgtctccttt tacttcaaac tttttaaaaa ctttaaagat gaccagagca tccaaaagag tgtggagacc atcaaggaag acatgaatgt caagtttttc aatagcaaca aaaagaaacg agatgacttc gaaaagctga ctaattattc ggtaactgac ttgaatgtcc aacgcaaagc aatacatgaa ctcatccaag tgatggctga actgtcgcca gcagctaaaa cagggaagcg aaaaaggagt cagatgctgt tcgaggt
```

Non-limiting examples of commercial ELISA assays that can be used to determine the expression level of granzyme B are available from RayBiotech, Thermo Fisher Scientific, and R&D Systems. The protein and cDNA sequences for mature human granzyme B are shown below.

```
Mature Human Granzyme B
                                    (SEQ ID NO: 71)
iiggheakph srpymaylmi wdqkslkrcg gflirddfvl taahcwgssi nvtlgahnik egeptqqfip vkrpiphpay npknfsndim llqlerkakr travqplrlp snkaqvkpgq tcsvagwgqt aplgkhshtl qevkmtvqed rkcesdlrhy ydstielcvg dpeikktsfk gdsggplvcn kvaqgivsyg rnngmpprac tkvssfvhwi kktmkry Human Granzyme B cDNA
                                    (SEQ ID NO: 72)
atcatcgggg gacatgaggc caagccccac tcccgcccct acatggctta tcttatgatc tgggatcaga agtctctgaa gaggtgcggt ggcttcctga tacgagacga cttcgtgctg acagctgctc actgttgggg aagctccata aatgtcacct tgggggccca caatatcaaa gaacaggagc cgacccagca gtttatccct gtgaaaagac ccatcccca tccagcctat aatcctaaga acttctccaa cgacatcatg ctactgcagc tggagagaaa ggccaagcgg accagagctg tgcagcccct caggctacct agcaacaagg cccaggtgaa gccagggcag acatgcagtg tggccggctg ggggcagacg gccccctgg gaaaacactc acacacacta caagaggtga agatgacagt gcaggaagat cgaaagtgcg aatctgactt acgccattat tacgacagta ccattgagtt gtgcgtgggg gacccagaga ttaaaaagac ttcctttaag ggggactctg gaggccctct tgtgtgtaac aaggtggccc agggcattgt ctcctatgga cgaaacaatg gcatgcctcc acgagcctgc accaaagtct caagctttgt acactggata aagaaaacca tgaaacgcta c
```

Non-limiting examples of commercial ELISA assays that can be used to determine the expression level of MYC are available from Invitrogen, LSBio, Biocodon Technologies, and Elisa Genie. The protein and cDNA sequences for mature human MYC are shown below.

```
Human Myc Protein
                                    (SEQ ID NO: 329)
mdffrvveng qppatmplnv sftnrnydld ydsvqpyfyc deeenfyqqq qqselqppap sediwkkfel lptpplspsr rsglcspsyv avtpfslrgd ndggggsfst adqlemvtel lggdmvnqsf icdpddetfi kniiiqdcmw sgfsaaaklv seklasyqaa rkdsgspnpa rghsvcstss lylqdlsaaa secidpsvvf pyplndsssp kscasqdssa fspssdslls stesspqgsp eplvlheetp pttssdseee qedeeeidvv svekrqapgk rsesgspsag ghskpphspl vlkrchvsth qhnyaappst rkdypaakrv kldsvrvlrq isnnrkctsp
```

```
rssdteenvk rrthnvlerq rrnelkrsff alrdqipele nnekapkvvi lkkatayils vqaeeqklis eedllrkrre qlkhkleqlr nsca Human Myc cDNA
                                         (SEQ ID NO: 330)
ctggatt tttttcgggt agtggaaaac cagcagcctc ccgcgacgat gccccctcaac gttagcttca ccaacaggaa ctatgacctc gactacgact cggtgcagcc gtatttctac tgcgacgagg aggagaactt ctaccagcag cagcagcaga gcgagctgca gccccggcg cccagcgagg atatctggaa gaaattcgag ctgctgccca ccccgccccct gtcccctagc cgccgctccg ggctctgctc gccctcctac gttgcggtca caccccttctc ccttcgggga gacaacgacg gcggtggcgg gagcttctcc acggccgacc agctggagat ggtgaccgag ctgctgggag gagacatggt gaaccgagt ttcatctgcg acccggacga cgagaccttc atcaaaaaca tcatcatcca ggactgtatg tggagcggct tctcggccgc cgccaagctc gtctcagaga agctggcctc ctaccaggct gcgcgcaaag acagcggcag cccgaacccc gcccgcggcc acagcgtctg ctccacctcc agcttgtacc tgcaggatct gagcgccgcc gcctcagagt gcatcgaccc ctcggtggtc ttcccctacc ctctcaacga cagcagctcg cccaagtcct gcgcctcgca agactccagc gccttctctc cgtcctcgga ttctctgctc tcctcgacgg agtcctcccc gcagggcagc cccgagcccc tggtgctcca tgaggagaca ccgcccacca ccagcagcga ctctgaggag gaacaagaag atgaggaaga aatcgatgtt gtttctgtgg aaaagaggca ggctcctggc aaaaggtcag agtctggatc acccttctgct ggaggccaca gcaaaacctcc tcacagccca ctggtcctca agaggtgcca cgtctccaca catcagcaca actacgcagc gcctccctcc actcggaagg actatcctgc tgccaagagg gtcaagttgg acagtgtcag agtcctgaga cagatcagca acaaccgaaa atgcaccagc cccaggtcct cggacaccga ggagaatgtc aagaggcgaa cacacaacgt cttggagcgc cagaggagga acgagctaaa acggagcttt tttgccctgc gtgaccagat cccggagttg gaaaacaatg aaaaggcccc caaggtagtt atccttaaaa aagccacagc atacatcctg tccgtccaag cagaggagca aaagctcatt tctgaagagg acttgttgcg gaaacgacga gaacagttga aacacaaact tgaacagcta cggaactctt gtgcgtaa
```

In some embodiments, activated NK cells (e.g., human activated NK cells) can show increased (e.g., at least a 10% increase, at least a 20% increase, at least a 30% increase, at least a 40% increase, at least a 50% increase, at least a 60% increase, at least a 70% increase, at least 80% increase, at least a 90% increase, at least a 100% increase, at least a 120% increase, at least a 140% increase, at least a 160% increase, at least a 180% increase, at least a 200% increase, at least a 220% increase, at least a 240% increase, at least a 260% increase, at least a 280% increase, or at least a 300% increase) ability to kill senescent cells (e.g., any of the senescent cells described herein) in a subject (e.g., any of the subjects described herein) or in vitro as compared to resting NK cells (e.g., human resting NK cells).

In some embodiments, activated NK cells (e.g., human activated NK cells) can show about a 10% increase to about a 500% increase (or any of the subranges of this range described herein) ability to kill senescent cells (e.g., any of the senescent cells described herein) in a subject (e.g., any of the subjects described herein) or in vivo as compared to resting NK cells (e.g., human resting NK cells).

In some embodiments, activated NK cells (e.g., human activated NK cells) can show increased (e.g., at least a 10% increase, at least a 20% increase, at least a 30% increase, at least a 40% increase, at least a 50% increase, at least a 60% increase, at least a 70% increase, at least 80% increase, at least a 90% increase, at least a 100% increase, at least a 120% increase, at least a 140% increase, at least a 160% increase, at least a 180% increase, at least a 200% increase, at least a 220% increase, at least a 240% increase, at least a 260% increase, at least a 280% increase, or at least a 300% increase) cytotoxic activity in a contact-cytotoxicity assay in the presence of an antibody that binds specifically to an antigen present on a senescent or target cell, e.g., as compared to a resting NK cell (e.g., human resting NK cells).

In some embodiments, activated NK cells (e.g., human activated NK cells) can show increased (e.g., about a 10% increase to about a 500% increase, or any of the subranges of this range described herein) cytotoxic activity in a contact-cytotoxicity assay in the presence of an antibody that binds specifically to an antigen present on a senescent or target cell, e.g., as compared to a resting NK cell (e.g., human resting NK cells).

In some embodiments, an activated NK cell can be produced by a method that includes obtaining a resting NK cell; and contacting the resting NK cell in vitro in a liquid culture medium including one or more NK cell activating agent(s), where the contacting results in the generation of the activated NK cells that are subsequently administered to the subject. In some examples of these methods, the resting NK cell is an autologous NK cell obtained from the subject. In some examples of these methods, the resting NK cell is an autologous NK cell obtained from the subject. In some examples of these methods, the resting NK cell is an haploidentical resting NK cells. In some examples of these methods, the resting NK cell is an allogeneic resting NK cell. In some examples of these methods, the resting NK cell is an artificial NK cell. In some examples of any of these methods, the resting NK cell is a genetically-engineered NK cell carrying a chimeric antigen receptor or recombinant T cell receptor.

In some examples of these methods, the liquid culture medium is a serum-free liquid culture medium. In some embodiments of any of the methods described herein, the liquid culture medium is a chemically-defined liquid culture medium. Some examples of these methods further include isolating the activated NK cells (and optionally further administering a therapeutically effective amount of the activated NK cells to a subject, e.g., any of the subjects described herein).

In some embodiments of these methods, the contacting step is performed for a period of about 2 hours to about 20 days (e.g., about 2 hours to about 18 days, about 2 hours to about 16 days, about 2 hours to about 14 days, about 2 hours to about 12 days, about 2 hours to about 10 days, about 2 hours to about 8 days, about 2 hours to about 7 days, about 2 hours to about 6 days, about 2 hours to about 5 days, about 2 hours to about 4 days, about 2 hours to about 3 days, about 2 hours to about 2 days, about 2 hours to about 1 day, about 6 hours to about 18 days, about 6 hours to about 16 days, about 6 hours to about 14 days, about 6 hours to about 12 days, about 6 hours to about 10 days, about 6 hours to about 8 days, about 6 hours to about 7 days, about 6 hours to about 6 days, about 6 hours to about 5 days, about 6 hours to about 4 days, about 6 hours to about 3 days, about 6 hours to about 2 days, about 6 hours to about 1 day, about 12 hours to about 18 days, about 12 hours to about 16 days, about 12 hours to about 14 days, about 12 hours to about 12 days, about 12 hours to about 10 days, about 12 hours to about 8 days, about 12 hours to about 7 days, about 12 hours to about 6 days, about 12 hours to about 5 days, about 12 hours to about 4 days, about 12 hours to about 3 days, about 12 hours to about 2 days, about 12 hours to about 1 day, about 1 day to about 18 days, about 1 day to about 16 days, about 1 day to about 15 days, about 1 day to about 14 days, about 1 day to about 12 days, about 1 day to about 10 days, about 1 day to about 8 days, about 1 day to about 7 days, about 1 day to about 6 days, about 1 day to about 5 days, about 1 day to about 4 days, about 1 day to about 3 days, about 1 day to about 2 days, about 2 days to about 18 days, about 2 days to about 16 days, about 2 days to about 14 days, about 2 days to about 12 days, about 2 days to about 10 days, about 2 days to about 8 days, about 2 days to about 7 days, about 2 days to about 6 days, about 2 days to about 5 days, about 2 days to about 4 days, about 2 days to about 3 days, about 3 days to about 18 days, about 3 days to about 16 days, about 3 days to about 14 days, about 3 days to about 12 days, about 3 days to about 10 days, about 3 days to about 8 days, about 3 days to about 7 days, about 3 days to about 6 days, about 3 days to about 5 days, about 3 days to about 4 days, about 4 days to about 18 days, about 4 days to about 16 days, about 4 days to about 14 days, about 4 days to about 12 days, about 4 days to about 10 days, about 4 days to about 8 days, about 4 days to about 7 days, about 4 days to about 6 days, about 4 days to about 5 days, about 5 days to about 18 days, about 5 days to about 16 days, about 5 days to about 14 days, about 5 days to about 12 days, about 5 days to about 10 days, about 5 days to about 8 days, about 5 days to about 7 days, about 6 days to about 18 days, about 6 days to about 16 days, about 6 days to about 14 days, about 6 days to about 12 days, about 6 days to about 10 days, about 6 days to about 8 days, about 6 days to about 7 days, about 7 days to about 18 days, about 7 days to about 16 days, about 7 days to about 14 days, about 7 days to about 12 days, about 7 days to about 10 days, about 7 days to about 8 days, about 8 days to about 18 days, about 8 days to about 16 days, about 8 days to about 14 days, about 8 days to about 12 days, about 9 days to about 18 days, about 9 days to about 16 days, about 9 days to about 14 days, about 12 days to about 18 days, about 12 days to about 16 days, about 12 days to about 14 days, about 14 days to about 18 days, about 14 days to about 16 days, or about 16 days to about 18 days.

NK Cell Activating Agents

Provided herein are methods that include the use or administration of one or more NK cell activating agents. In some embodiments, an NK cell activating agent can be a protein. In some embodiments, an NK cell activating agent can be a single-chain chimeric polypeptide (e.g. any of the single-chain chimeric polypeptides described herein), a multi-chain chimeric polypeptide (e.g. any of the multi-chain chimeric polypeptides described herein, e.g., the exemplary type A and type B multi-chain chimeric polypeptides described herein), an antibody, a recombinant cytokine or an interleukin (e.g. any of the recombinant cytokines or interleukins described herein), and a soluble interleukin or cytokine receptor (e.g. any of the soluble interleukin or cytokine receptors described herein). In some embodiments, the NK cell activating agent can be a small molecule (e.g., a glycogen synthase kinase-3 (GSK3) inhibitor, e.g., CHIR99021 as described in Cichocki et al., Cancer Res. 77:5664-5675, 2017) or an aptamer.

In some embodiments of any of the one or more NK cell activating agents provided herein, at least one of the one or more NK cell activating agent(s) results in activation of one or more (e.g., two, three, four, five, six, seven, or eight) of: a receptor for IL-2, a receptor for IL-7, a receptor for IL-12, a receptor for IL-15, a receptor for IL-18, a receptor for IL-21, a receptor for IL-33, CD16, CD69, CD25, CD59, CD352, NKp80, DNAM-1, 2B4, NKp30, NKp44, NKp46, NKG2D, KIR2DS1, KIR2Ds2/3, KIR2DL4, KIR2DS4, KIR2DS5, and KIR3DS1 (e.g., in an immune cell, e.g., a human immune cell, e.g., a human NK cell) as compared to the level of activation in the absence of the one or more NK cell activating agent(s).

In some embodiments, the at least one of the one or more NK cell activating agent(s) that results in activation of a receptor for IL-2 is a soluble IL-2 or an agonistic antibody that binds specifically to an IL-2 receptor.

In some embodiments, the at least one of the one or more NK cell activating agent(s) that results in activation of a receptor for IL-7 is a soluble IL-7 or an agonistic antibody that binds specifically to an IL-7 receptor.

In some embodiments, the at least one of the one or more NK cell activating agent(s) that results in activation of a receptor for IL-12 is a soluble IL-12 or an agonistic antibody that binds specifically to an IL-12 receptor.

In some embodiments, the at least one of the one or more NK cell activating agent(s) that results in activation of a receptor for IL-15 is a soluble IL-15 or an agonistic antibody that binds specifically to an IL-15 receptor.

In some embodiments, the at least one of the one or more NK cell activating agent(s) that results in activation of a receptor for IL-21 is a soluble IL-21 or an agonistic antibody that binds specifically to an IL-21 receptor.

In some embodiments, the at least one of the one or more NK cell activating agent(s) that results in activation of a receptor for IL-33 is a soluble IL-33 or an agonistic antibody that binds specifically to an IL-33 receptor.

In some embodiments, the at least one of the one or more NK cell activating agent(s) that results in activation of CD16 is an agonistic antibody that binds specifically to CD16.

In some embodiments, the at least one of the one or more NK cell activating agent(s) that results in activation of CD69 is an agonistic antibody that binds specifically to CD69.

In some embodiments, the at least one of the one or more NK cell activating agent(s) that results in activation of CD25, CD59 is an agonistic antibody that binds specifically to CD25, CD59.

In some embodiments, the at least one of the one or more NK cell activating agent(s) that results in activation of CD352 is an agonistic antibody that binds specifically to CD352.

In some embodiments, the at least one of the one or more NK cell activating agent(s) that results in activation of NKp80 is an agonistic antibody that binds specifically to NKp80.

In some embodiments, the at least one of the one or more NK cell activating agent(s) that results in activation of DNAM-1 is an agonistic antibody that binds specifically to DNAM-1.

In some embodiments, the at least one of the one or more NK cell activating agent(s) that results in activation of 2B4 is an agonistic antibody that binds specifically to 2B4.

In some embodiments, the at least one of the one or more NK cell activating agent(s) that results in activation of NKp30 is an agonistic antibody that binds specifically to NKp30.

In some embodiments, the at least one of the one or more NK cell activating agent(s) that results in activation of NKp44 is an agonistic antibody that binds specifically to NKp44.

In some embodiments, the at least one of the one or more NK cell activating agent(s) that results in activation of NKp46 is an agonistic antibody that binds specifically to NKp46.

In some embodiments, the at least one of the one or more NK cell activating agent(s) that results in activation of NKG2D is an agonistic antibody that binds specifically to NKG2D.

In some embodiments, the at least one of the one or more NK cell activating agent(s) that results in activation of KIR2DS1 is an agonistic antibody that binds specifically to KIT2DS1.

In some embodiments, the at least one of the one or more NK cell activating agent(s) that results in activation of KIR2DS2/3 is an agonistic antibody that binds specifically to KIT2DS2/3.

In some embodiments, the at least one of the one or more NK cell activating agent(s) that results in activation of KIR2DL4 is an agonistic antibody that binds specifically to KIT2DL4.

In some embodiments, the at least one of the one or more NK cell activating agent(s) that results in activation of KIR2DS4 is an agonistic antibody that binds specifically to KIT2DS4.

In some embodiments, the at least one of the one or more NK cell activating agent(s) that results in activation of KIR2DS5 is an agonistic antibody that binds specifically to KIT2DS5.

In some embodiments, the at least one of the one or more NK cell activating agent(s) that results in activation of KIR3DS1 is an agonistic antibody that binds specifically to KIT3DS1.

In some embodiments of any of the one or more NK cell activating agents provided herein, at least one (e.g., two, three, four, or five) of the one or more NK cell activating agent(s) results in a decrease in the activation of one or more of: PD-1, a TGF-receptor, TIGIT, CD1, TIM-3, Siglec-7, IRP60, Tactile, IL1R8, NKG2A/KLRD1, KIR2DL1, KIR2DL2/3, KIR2DL5, KIR3DL1, KIR3DL2, ILT2/LIR-1, and LAG-2 (e.g., in an immune cell, e.g., a human immune cell, e.g., a human NK cell) as compared to the level of activation in the absence of the one or more NK cell activating agent(s).

In some embodiments, the at least one of the one or more NK cell activating agent(s) that results in a decrease in the activation of a TGF-β receptor is a soluble TGF-β receptor, an antibody that binds specifically to TGF-β, or an antagonistic antibody that binds specifically to a TGF-β receptor.

In some embodiments, the at least one of the one or more NK cell activating agent(s) that results in a decrease in the activation of TIGIT is an antagonistic antibody that binds specifically to TIGIT, a soluble TIGIT, or an antibody that binds specifically to a ligand of TIGIT.

In some embodiments, the at least one of the one or more NK cell activating agent(s) that results in a decrease in the activation of CD1 is an antagonistic antibody that binds specifically to CD1, a soluble CD1, or an antibody that binds specifically to a ligand of CD1.

In some embodiments, the at least one of the one or more NK cell activating agent(s) that results in a decrease in the activation of TIM-3 is an antagonistic antibody that binds specifically to TIM-3, a soluble TIM-3, or an antibody that binds specifically to a ligand of TIM-3.

In some embodiments, the at least one of the one or more NK cell activating agent(s) that results in a decrease in the activation of Siglec-7 is an antagonistic antibody that binds specifically to Siglec-7, a soluble Siglec-7, or an antibody that binds specifically to a ligand of Siglec-7.

In some embodiments, the at least one of the one or more NK cell activating agent(s) that results in a decrease in the activation of IRP-60 is an antagonistic antibody that binds specifically to IRP-60, a soluble IRP-60, or an antibody that binds specifically to a ligand of IRP-60.

In some embodiments, the at least one of the one or more NK cell activating agent(s) that results in a decrease in the activation of Tactile is an antagonistic antibody that binds specifically to Tactile, a soluble Tactile, or an antibody that binds specifically to a ligand of Tactile.

In some embodiments, the at least one of the one or more NK cell activating agent(s) that results in a decrease in the activation of IL is an antagonistic antibody that binds specifically to IL1R8, a soluble IL1R8, or an antibody that binds specifically to a ligand of IL1R8.

In some embodiments, the at least one of the one or more NK cell activating agent(s) that results in a decrease in the activation of NKG2A/KLRD1 is an antagonistic antibody that binds specifically to NKG2A/KLRD1, a soluble NKG2A/KLRD1, or an antibody that binds specifically to a ligand of NKG2A/KLRD1.

In some embodiments, the at least one of the one or more NK cell activating agent(s) that results in a decrease in the activation of KIR2DL1 is an antagonistic antibody that binds specifically to KIR2DL1, a soluble KIR2DL1, or an antibody that binds specifically to a ligand of KIR2DL1.

In some embodiments, the at least one of the one or more NK cell activating agent(s) that results in a decrease in the activation of KIR2DL2/3 is an antagonistic antibody that binds specifically to KIR2DL2/3, a soluble KIR2DL2/3, or an antibody that binds specifically to a ligand of KIR2DL2/3.

In some embodiments, the at least one of the one or more NK cell activating agent(s) that results in a decrease in the activation of KIR2DL5 is an antagonistic antibody that binds specifically to KIR2DL5, a soluble KIR2DL5, or an antibody that binds specifically to a ligand of KIR2DL5.

In some embodiments, the at least one of the one or more NK cell activating agent(s) that results in a decrease in the activation of KIR3DL1 is an antagonistic antibody that binds specifically to K1R3DL1, a soluble KIR3DL1, or an antibody that binds specifically to a ligand of KIR3DL1.

In some embodiments, the at least one of the one or more NK cell activating agent(s) that results in a decrease in the activation of KIR3DL2 is an antagonistic antibody that binds specifically to KIR3DL2, a soluble KIR3DL2, or an antibody that binds specifically to a ligand of KIR3DL2.

In some embodiments, the at least one of the one or more NK cell activating agent(s) that results in a decrease in the activation of ILT2/LIR-1 is an antagonistic antibody that binds specifically to ILT2/LIR-1, a soluble ILT2/LIR-1, or an antibody that binds specifically to a ligand of ILT2/LIR-1.

In some embodiments, the at least one of the one or more NK cell activating agent(s) that results in a decrease in the activation of LAG2 is an antagonistic antibody that binds specifically to LAG2, a soluble LAG2, or an antibody that binds specifically to a ligand of LAG2.

Non-limiting examples of NK cell activating agents are described below and can be used in any combination.

In some examples, an NK cell activating agents can be a soluble PD-1, a soluble PD-L1, a soluble TIGIT, a soluble CD1, or a soluble TIM-3. Non-limiting examples of soluble PD-1, PD-L1, TIGIT, CD1, and TIM-3 are provided below.

```
Human Soluble PD-1
                                          (SEQ ID NO: 73)
pgwfldspdr pwnpptfspa llvvtegdna tftcsfsnts esfvlnwyrm spsnqtdkla afpedrsqpg qdcrfrvtql pngrdfhmsv vrarrndsgt ylcgaislap kaqikeslra elrvterrae vptahpspsp rpagqfqtlv vgvvggllgs lvllvwvlav icsraargti garrtgqplk edpsavpvfs vdygeldfqw rektpeppvp cvpeqteyat ivfpsgmgts sparrgsadg prsaqplrpe dghcswpl Human Soluble PD-L1
                                          (SEQ ID NO: 74)
ftvtvpkdlyvv eygsnmtiec kfpvekqldl aalivyweme dkniiqfvhg eedlkvqhss yrgrarllkd qlslgnaalq itdvklqdag vyrcmisygg adykritvkv napynkingr ilvvdpvtse heltcqaegy pkaeviwtss dhqvlsgktt ttnskreekl fnvtstlrin tttneifyct frrldpeenh taelvipelp lahppnerth lvilgaillc lgvaltfifr lrkgrmmdvk kcgiqdtnsk kqsdthleet Human Soluble TIGIT
                                          (SEQ ID NO: 75)
mmtgtiett gnisaekggs iilqchlsst taqvtqvnwe qqdqllaicn adlgwhisps fkdrvapgpg lgltlqsltv ndtgeyfciy htypdgtytg riflevless vaehgarfqi pllgamaatl vvictavivv valtrkkkal rihsvegdlr rksagqeews psapsppgsc vqaeaapagl cgeqrgedca elhdyfnvls yrslgncsff tetg Human Soluble CD1A
                                          (SEQ ID NO: 76)
nadglkeplsfhvt wiasfynhsw kqnlvsgwls dlqthtwdsn sstivflcpw srgnfsneew keletlfrir tirsfegirr yahelqfeyp feiqvtggce lhsgkvsgsf lqlayqgsdf vsfannswlp ypvagnmakh fckvlnqnqh endithnlls dtcprfilgl ldagkahlqr qvkpeawlsh gpspgpghlq lvchvsgfyp kpvwvmwmrg eqeqqgtqrg dilpsadgtw ylratlevaa geaadlscrv khsslegqdi vlywehhssv gfiilavivp lllliglalw frkrcfc Human Soluble TIM3
                                          (SEQ ID NO: 77)
seveyraev gqnaylpcfy tpaapgnlvp vcwgkgacpv fecgnvvlrt derdvnywts rywlngdfrk gdvsltienv tladsgiycc riqipgimnd ekfnlklvik pakvtpaptr qrdftaafpr mlttrghgpa etqtlgslpd inltqistla nelrdsrlan dlrdsgatir igiyigagic aglalalifg alifkwyshs kekiqnlsli slanlppsgl anavaegirs eeniytieen vyeveepney ycyvssrqqp sqplgcrfam
```

In some embodiments, a soluble PD-1 protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 73.

In some embodiments, a soluble PD-L1 protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 74.

In some embodiments, a soluble TIGIT protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 75.

In some embodiments, a soluble CD1A protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 76.

In some embodiments, a soluble TIM3 protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 77.

Recombinant Antibodies

In some examples, NK activating agent can be: an agonistic antibody that binds specifically to an IL-2 receptor (see, e.g., those described in Gaulton et al., *Clinical Immunology and Immunopathology* 36(1):18-29, 1985), an agonistic antibody that binds specifically to an IL-7 receptor, an agonistic antibody that binds specifically to IL-12 receptor (see, e.g., those described in Rogge et al., *J. Immunol.* 162(7): 3926-3932, 1999), an agonistic antibody that binds specifically to an IL-15 receptor, an agonistic antibody that binds specifically to an IL-21 receptor (see, e.g., those described in U.S. Patent Application Publication No. 2006/159655), an agonistic antibody that binds specifically to an IL-33 receptor (see, e.g., those described in U.S. Patent Application Publication No. 2007/160579), an antagonistic antibody that binds specifically to PD-1 (see, e.g., those described in U.S. Pat. No. 7,521,051), an antibody that binds specifically to PD-L1 (see, e.g., those described in U.S. Pat. No. 8,217,149), an antibody that binds specifically to TGF-β, an antagonistic antibody that binds specifically to TGF-β receptor (see, e.g., those described in European Patent Application Publication No. 1245676 A1), an antagonistic antibody that binds specifically to TIGIT (see, e.g., those described in WO 2017/053748), an antibody that binds specifically to a ligand of TIGIT (see, e.g., those described in WO 2011/127324), an antagonistic antibody that binds specifically to CD1 (see, e.g., those described in Szalay et al., *J. Immunol.* 162(12):6955-6958, 1999), an antibody that binds specifically to a ligand of CD1 (see, e.g., those described in Kain et al., *Immunity* 41(4):543-554, 2014), an antagonistic antibody that binds specifically to TIM-3 (see, e.g., those described in U.S. Patent Application Publication No. 2015/218274), an antibody that binds specifically to a ligand of TIM-3 (see, e.g., those described in U.S. Patent Application Publication No. 2017/283499), an agonistic antibody that binds specifically to CD69 (see, e.g., those described in Moretta et al., Journal of Experimental Medicine 174:1393, 1991), an agonistic antibody that binds specifically to CD25, CD59, an agonistic antibody that binds specifically to CD352 (see, e.g., those described in Yigit et al., *Oncotarget* 7:26346-26360, 2016), an agonistic antibody that binds specifically to NKp80 (see, e.g., those described in Peipp et al., *Oncotarget* 6:32075-32088, 2015), an agonistic antibody that binds specifically to DNAM-1, an agonistic antibody that binds specifically to 2B4 (see, e.g., those described in Sandusky et al., European *J. Immunol.* 36:3268-3276, 2006), an agonistic antibody that binds specifically to NKp30 (see, e.g., those described in Kellner et al., *OncoImmunology* 5:1-12, 2016), an agonistic antibody that binds specifically to NKp44, an agonistic antibody that binds specifically to NKp46 (see, e.g., those described in Xiong et al., *J. Clin. Invest.* 123:4264-4272, 2013), an agonistic antibody that binds specifically to NKG2D (see, e.g., those described in Kellner et al., *OncoImmunology* 5:1-12, 2016), an agonistic antibody that binds specifically to KIR2DS1 (see, e.g., those described in Xiong et al., *J. Clin. Invest.* 123:4264-4272, 2013), an agonistic antibody that binds specifically to KIR2Ds2/3 (see, e.g., those described in Borgerding et al., *Exp. Hematology* 38:213-221, 2010), an agonistic antibody that binds specifically to KIR2DL4 (see, e.g., those described in Miah et al., *J. Immunol.* 180:2922-32, 2008), an agonistic antibody that binds specifically to KIR2DS4 (see, e.g., those described in Czaja et al., *Genes and Immunity* 15:33-37, 2014), an agonistic antibody that binds specifically to KIR2DS5 (see, e.g., those described in Czaja et al., *Genes and Immunity* 15:33-37, 2014), an agonistic antibody that binds specifically to KIR3DS1 (see, e.g., those described in Czaja et al., *Genes and Immunity* 15:33-37, 2014), an antagonistic antibody that binds specifically to Siglec-7 (see, e.g., those described in Hudak et al., *Nature Chemical Biology* 10:69-75, 2014), an antagonistic antibody that binds specifically to IRP60 (see, e.g., those described in Bachelet et al., *J. Biol. Chem.* 281:27190-27196, 2006), an antagonistic antibody that binds specifically to Tactile (see, e.g., those described in Brooks et al., *Eur. J. Cancer* 61(Suppl. 1):S189, 2016), an antagonistic antibody that binds specifically to IL1R8 (see, e.g., those described in Molgora et al., *Frontiers Immunol.* 7:1, 2016), an antagonistic antibody that binds specifically to NKG2A/KLRD1 (see, e.g., those described in Kim et al., *Infection Immunity* 76:5873-5882, 2008), an antagonistic antibody that binds specifically to KIR2DL1 (see, e.g., those described in Weiner et al., *Cell* 148:1081-1084, 2012), an antagonistic antibody that binds specifically to KIR2DL2/3 (see, e.g., those described in Weiner et al., *Cell* 148:1081-1084, 2012), an antagonistic antibody that binds specifically to KIR2DL5 (see, e.g., those described in U.S. Pat. No. 9,067,997), and an antagonistic antibody that binds specifically KIR3DL1 (see, e.g., those described in U.S. Pat. No. 9,067,997), an antagonistic antibody that binds specifically to KIR3DL2 (see, e.g., those described in U.S. Pat. No. 9,067,997), an antagonistic antibody that binds specifically to ILT2/LIR-1 (see, e.g., those described in U.S. Pat. No. 8,133,485), and an antagonistic antibody that binds specifically to LAG-2.

A recombinant antibody that is an NK cell activating agent can be any of exemplary types of antibodies (e.g., a human or humanized antibody) or any of the exemplary antibody fragments described herein. A recombinant antibody that is an NK cell activating agent can include, e.g., any of the antigen-binding domains described herein.

Recombinant Interleukins or Cytokines

In some examples, NK activating agents can be, e.g., a soluble IL-2, a soluble IL-7, a soluble IL-12, a soluble IL-15, a soluble IL-21, and a soluble IL-33. Non-limiting examples of soluble IL-12, IL-15, IL-21, and IL-33. are provided below.

Human Soluble IL-2
(SEQ ID NO: 78)
aptssstkkt qlqlehllld lqmilnginn yknpkltrml tfkfympkka telkhlqcle eelkpleevl nlaqsknfhl rprdlisnin vivlelkgse ttfmceyade tativeflnr witfcqsiis tlt Human Soluble IL-7
(SEQ ID NO: 79)
dcdiegkdgkqyesv lmvsidqlld smkeigsncl nnefnffkrh icdankegmf lfraarklrq flkmnstgdf dlhllkvseg ttillnctgq vkgrkpaalg eaqptkslee nkslkeqkkl ndlcflkrll qeiktcwnki lmgtkeh Human Soluble IL-12 subunit alpha
(SEQ ID NO: 80)
rnlpvatp dpgmfpclhh sqnllravsn mlqkarqtle fypctseeid heditkdkts tveaclplel tknesclnsr etsfitngsc lasrktsfmm alclssiyed lkmyqvefkt mnakllmdpk rqifldqnml avidelmqal nfnsetvpqk ssleepdfyk tkiklcillh afriravtid rvmsylnas Human Soluble IL-12 subunit beta
(SEQ ID NO: 81)
iwelkkdv yvveldwypd apgemvvltc dtpeedgitw tldqssevlg sgktltiqvk efgdagqytc hkggevlshs llllhkkedg iwstdilkdq kepknktflr ceaknysgrf tcwwlttist dltfsvkssr gssdpqgvtc gaatlsaerv rgdnkeyeys vecqedsacp aaeeslpiev mvdavhklky enytssffir diikpdppkn lqlkplknsr qvevsweypd -continued twstphsyfs ltfcvqvqgk skrekkdrvf tdktsatvic rknasisvra qdryysssws ewasvpcs Human Soluble IL-15
(SEQ ID NO: 82)
Nwvnvisdlkki edliqsmhid atlytesdvh psckvtamkc fllelqvisl esgdasihdt venliilann slssngnvte sgckeceele eknikeflqs fvhivqmfin ts Human Soluble IL-21
(SEQ ID NO: 83)
qgqdrhmi rmrqlidivd qlknyvndlv peflpapedv etncewsafs cfqkaqlksa ntgnneriin vsikklkrkp pstnagrrqk hrltcpscds yekkppkefl erfksllqkm ihqhlssrth gseds Human Soluble IL-33
(SEQ ID NO: 84)
mkpkmkystn kistakwknt askalcfklg ksqqkakevc pmyfmklrsg lmikkeacyf rrettkrpsl ktgrkhkrhl vlaacqqqst vecfafgisg vqkytralhd ssitgispit eylaslstyn dqsitfaled esyeiyvedl kkdekkdkvl lsyyesqhps nesgdgvdgk mlmvtlsptk dfwlhannke hsvelhkcek plpdqaffvl hnmhsncvsf ecktdpgvfi gvkdnhlali kvdssenlct enilfklset In some embodiments, a soluble IL-2 protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 78.

In some embodiments, a soluble IL-7 protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 79.

In some embodiments, a soluble IL-2 protein includes a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 80 and a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 81.

In some embodiments, a soluble IL-15 protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 82.

In some embodiments, a soluble IL-21 protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 83.

In some embodiments, a soluble IL-33 protein can include a sequence that is at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 84.

Soluble Cytokine or Interleukin Receptors

In some examples of any of the soluble cytokine or interleukin receptors described herein, the soluble cytokine or interleukin receptors can be a soluble TGF-β receptor. In some examples, the soluble TGF-β receptor is a soluble TGF-β receptor I (TGF-βRI) (see, e.g., those described in Docagne et al., *Journal of Biological Chemistry* 276(49): 46243-46250, 2001), a soluble TGF-β receptor II (TGF-βRII) (see, e.g., those described in Yung et al., *Am. J. Resp. Crit. Care Med.* 194(9):1140-1151, 2016), a soluble TGF-βRIII (see, e.g., those described in Heng et al., *Placenta* 57:320, 2017). In some examples, the soluble TGF-β receptor is a receptor "trap" for TGF-β (see, e.g., those described in Zwaagstra et al., *Mol. Cancer Ther.* 11(7):1477-1487, 2012, and those described in De Crescenzo et al. *Transforming Growth Factor-β in Cancer Therapy, Volume II*, pp 671-684).

Additional examples of soluble cytokine or soluble interleukin receptors are known in the art.

Single Chain Chimeric Polypeptides

Non-limiting examples of NK cell activating agents are single-chain chimeric polypeptides that include: (i) a first target-binding domain (e.g., any of the target-binding domains described herein or known in the art), (ii) a soluble tissue factor domain (e.g., any of the exemplary soluble tissue factor domains described herein or known in the art), and (iii) as second target-binding domain (e.g., any of the target-binding domains described herein or known in the art).

In some examples of any of the single-chain chimeric polypeptides described herein, the single-chain chimeric polypeptide can have a total length of about 50 amino acids to about 3000 amino acids, about 50 amino acids to about 2500 amino acids, about 50 amino acids to about 2000 amino acids, about 50 amino acids to about 1500 amino acids, about 50 amino acids to about 1000 amino acids, about 50 amino acids to about 950 amino acids, about 50 amino acids to about 900 amino acids, about 50 amino acids to about 850 amino acids, about 50 amino acids to about 800 amino acids, about 50 amino acids to about 750 amino acids, about 50 amino acids to about 700 amino acids, about 50 amino acids to about 650 amino acids, about 50 amino acids to about 600 amino acids, about 50 amino acids to about 550 amino acids, about 50 amino acids to about 500 amino acids, about 50 amino acids to about 480 amino acids, about 50 amino acids to about 460 amino acids, about 50 amino acids to about 440 amino acids, about 50 amino acids to about 420 amino acids, about 50 amino acids to about 400 amino acids, about 50 amino acids to about 380 amino acids, about 50 amino acids to about 360 amino acids, about 50 amino acids to about 340 amino acids, about 50 amino acids to about 320 amino acids, about 50 amino acids to about 300 amino acids, about 50 amino acids to about 280 amino acids, about 50 amino acids to about 260 amino acids, about 50 amino acids to about 240 amino acids, about 50 amino acids to about 220 amino acids, about 50 amino acids to about 200 amino acids, about 50 amino acids to about 150 amino acids, about 50 amino acids to about 100 amino acids, about 100 amino acids to about 3000 amino acids, about 100 amino acids to about 2500 amino acids, about 100 amino acids to about 2000 amino acids, about 100 amino acids to about 1500 amino acids, about 100 amino acids to about 1000 amino acids, about 100 amino acids to about 950 amino acids, about 100 amino acids to about 900 amino acids, about 100 amino acids to about 850 amino acids, about 100 amino acids to about 800 amino acids, about 100 amino acids to about 750 amino acids, about 100 amino acids to about 700 amino acids, about 100 amino acids to about 650 amino acids, about 100 amino acids to about 600 amino acids, about 100 amino acids to about 550 amino acids, about 100 amino acids to about 500 amino acids, about 100 amino acids to about 480 amino acids, about 100 amino acids to about 460 amino acids, about 100 amino acids to about 440 amino acids, about 100 amino acids to about 420 amino acids, about 100 amino acids to about 400 amino acids, about 100 amino acids to about 380 amino acids, about 100 amino acids to about 360 amino acids, about 100 amino acids to about 340 amino acids, about 100 amino acids to about 320 amino acids, about 100 amino acids to about 300 amino acids, about 100 amino acids to about 280 amino acids, about 100 amino acids to about 260 amino acids, about 100 amino acids to about 240 amino acids, about 100 amino acids to about 220 amino acids, about 100 amino acids to about 200 amino acids, about 100 amino acids to about 150 amino acids, about 150 amino acids to about 3000 amino acids, about 150 amino acids to about 2500 amino acids, about 150 amino acids to about 2000 amino acids, about 150 amino acids to about 1500 amino acids, about 150 amino acids to about 1000 amino acids, about 150 amino acids to about 950 amino acids, about 150 amino acids to about 900 amino acids, about 150 amino acids to about 850 amino acids, about 150 amino acids to about 800 amino acids, about 150 amino acids to about 750 amino acids, about 150 amino acids to about 700 amino acids, about 150 amino acids to about 650 amino acids, about 150 amino acids to about 600 amino acids, about 150 amino acids to about 550 amino acids, about 150 amino acids to about 500 amino acids, about 150 amino acids to about 480 amino acids, about 150 amino acids to about 460 amino acids, about 150 amino acids to about 440 amino acids, about 150 amino acids to about 420 amino acids, about 150 amino acids to about 400 amino acids, about 150 amino acids to about 380 amino acids, about 150 amino acids to about 360 amino acids, about 150 amino acids to about 340 amino acids, about 150 amino acids to about 320 amino acids, about 150 amino acids to about 300 amino acids, about 150 amino acids to about 280 amino acids, about 150 amino acids to about 260 amino acids, about 150 amino acids to about 240 amino acids, about 150 amino acids to about 220 amino acids, about 150 amino acids to about 200 amino acids, about 200 amino acids to about 3000 amino acids, about 200 amino acids to about 2500 amino acids, about 200 amino acids to about 2000 amino acids, about 200 amino acids to about 1500 amino acids, about 200 amino acids to about 1000 amino acids, about 200 amino acids to about 950 amino acids, about 200 amino acids to about 900 amino acids, about 200 amino acids to about 850 amino acids, about 200 amino acids to about 800 amino acids, about 200 amino acids to about 750 amino acids, about 200 amino acids to about 700 amino acids, about 200 amino acids to about 650 amino acids, about 200 amino acids to about 600 amino acids, about 200 amino acids to about 550 amino acids, about 200 amino acids to about 500 amino acids, about 200 amino acids to about 480 amino acids, about 200 amino acids to about 460 amino acids, about 200 amino acids to about 440 amino acids, about 200 amino acids to about 420 amino acids, about 200 amino acids to about 400 amino acids, about 200 amino acids to about 380 amino acids, about 200 amino acids to about 360 amino acids, about 200 amino acids to about 340 amino acids, about 200 amino acids to about 320 amino acids, about 200 amino acids to about 300 amino acids, about 200 amino acids to about 280 amino acids, about 200 amino acids to about 260 amino acids, about 200 amino acids to about 240 amino acids, about 200 amino acids to about 220 amino acids, about 220 amino acids to about 3000 amino acids, about 220 amino acids to about 2500 amino acids, about 220 amino acids to about 2000 amino acids, about 220 amino acids to about 1500 amino acids, about 220 amino acids to about 1000 amino acids, about 220 amino acids to about 950 amino acids, about 220 amino acids to about 900 amino acids, about 220 amino acids to about 850 amino acids, about 220 amino acids to about 800 amino acids, about 220 amino acids to about 750 amino acids, about 220 amino acids to about 700 amino acids, about 220 amino acids to about 650 amino acids, about 220 amino acids to about 600 amino acids, about 220 amino acids to about 550 amino acids, about 220 amino acids to about 500 amino acids, about 220 amino acids to about 480 amino acids, about 220 amino acids to about 460 amino acids, about 220 amino acids to about 440 amino acids, about 220 amino acids to about 420 amino acids, about 220 amino acids to about 400 amino acids, about 220 amino acids to about 380 amino acids, about 220 amino acids to about 360 amino acids, about 220 amino acids to about 340 amino acids, about 220 amino acids to about 320 amino acids, about 220 amino acids to about 300 amino acids, about 220 amino acids to about 280 amino acids, about 220 amino acids to about 260 amino acids, about 220 amino acids to about 240 amino acids, about 240 amino acids to about 3000 amino acids, about 240 amino acids to about 2500 amino acids, about 240 amino acids to about 2000 amino acids, about 240 amino acids to about 1500 amino acids, about 240 amino acids to about 1000 amino acids, about 240 amino acids to about 950 amino acids, about 240 amino acids to about 900 amino acids, about 240 amino acids to about 850 amino acids, about 240 amino acids to about 800 amino acids, about 240 amino acids to about 750 amino acids, about 240 amino acids to about 700 amino acids, about 240 amino acids to about 650 amino acids, about 240 amino acids to about 600 amino acids, about 240 amino acids to about 550 amino acids, about 240 amino acids to about 500 amino acids, about 240 amino acids to about 480 amino acids, about 240 amino acids to about 460 amino acids, about 240 amino acids to about 440 amino acids, about 240 amino acids to about 420 amino acids, about 240 amino acids to about 400 amino acids, about 240 amino acids to about 380 amino acids, about 240 amino acids to about 360 amino acids, about 240 amino acids to about 340 amino acids, about 240 amino acids to about 320 amino acids, about 240 amino acids to about 300 amino acids, about 240 amino acids to about 280 amino acids, about 240 amino acids to about 260 amino acids, about 260 amino acids to about 3000 amino acids, about 260 amino acids to about 2500 amino acids, about 260 amino acids to about 2000 amino acids, about 260 amino acids to about 1500 amino acids, about 260 amino acids to about 1000 amino acids, about 260 amino acids to about 950 amino acids, about 260 amino acids to about 900 amino acids, about 260 amino acids to about 850 amino acids, about 260 amino acids to about 800 amino acids, about 260 amino acids to about 750 amino acids, about 260 amino acids to about 700 amino acids, about 260 amino acids to about 650 amino acids, about 260 amino acids to about 600 amino acids, about 260 amino acids to about 550 amino acids, about 260 amino acids to about 500 amino acids, about 260 amino acids to about 480 amino acids, about 260 amino acids to about 460 amino acids, about 260 amino acids to about 440 amino acids, about 260 amino acids to about 420 amino acids, about 260 amino acids to about 400 amino acids, about 260 amino acids to about 380 amino acids, about 260 amino acids to about 360 amino acids, about 260 amino acids to about 340 amino acids, about 260 amino acids to about 320 amino acids, about 260 amino acids to about 300 amino acids, about 260 amino acids to about 280 amino acids, about 280 amino acids to about 3000 amino acids, about 280 amino acids to about 2500 amino acids, about 280 amino acids to about 2000 amino acids, about 280 amino acids to about 1500 amino acids, about 280 amino acids to about 1000 amino acids, about 280 amino acids to about 950 amino acids, about 280 amino acids to about 900 amino acids, about 280 amino acids to about 850 amino acids, about 280 amino acids to about 800 amino acids, about 280 amino acids to about 750 amino acids, about 280 amino acids to about 700 amino acids, about 280 amino acids to about 650 amino acids, about 280 amino acids to about 600 amino acids, about 280 amino acids to about 550 amino acids, about 280 amino acids to about 500 amino acids, about 280 amino acids to about 480 amino acids, about 280 amino acids to about 460 amino acids, about 280 amino acids to about 440 amino acids, about 280 amino acids to about 420 amino acids, about 280 amino acids to about 400 amino acids, about 280 amino acids to about 380 amino acids, about 280 amino acids to about 360 amino acids, about 280 amino acids to about 340 amino acids, about 280 amino acids to about 320 amino acids, about 280 amino acids to about 300 amino acids, about 300 amino acids to about 3000 amino acids, about 300 amino acids to about 2500 amino acids, about 300 amino acids to about 2000 amino acids, about 300 amino acids to about 1500 amino acids, about 300 amino acids to about 1000 amino acids, about 300 amino acids to about 950 amino acids, about 300 amino acids to about 900 amino acids, about 300 amino acids to about 850 amino acids, about 300 amino acids to about 800 amino acids, about 300 amino acids to about 750 amino acids, about 300 amino acids to about 700 amino acids, about 300 amino acids to about 650 amino acids, about 300 amino acids to about 600 amino acids, about 300 amino acids to about 550 amino acids, about 300 amino acids to about 500 amino acids, about 300 amino acids to about 480 amino acids, about 300 amino acids to about 460 amino acids, about 300 amino acids to about 440 amino acids, about 300 amino acids to about 420 amino acids, about 300 amino acids to about 400 amino acids, about 300 amino acids to about 380 amino acids, about 300 amino acids to about 360 amino acids, about 300 amino acids to about 340 amino acids, about 300 amino acids to about 320 amino acids, about 320 amino acids to about 3000 amino acids, about 320 amino acids to about 2500 amino acids, about 320 amino acids to about 2000 amino acids, about 320 amino acids to about 1500 amino acids, about 320 amino acids to about 1000 amino acids, about 320 amino acids to about 950 amino acids, about 320 amino acids to about 900 amino acids, about 320 amino acids to about 850 amino acids, about 320 amino acids to about 800 amino acids, about 320 amino acids to about 750 amino acids, about 320 amino acids to about 700 amino acids, about 320 amino acids to about 650 amino acids, about 320 amino acids to about 600 amino acids, about 320 amino acids to about 550 amino acids, about 320 amino acids to about 500 amino acids, about 320 amino acids to about 480 amino acids, about 320 amino acids to about 460 amino acids, about 320 amino acids to about 440 amino acids, about 320 amino acids to about 420 amino acids, about 320 amino acids to about 400 amino acids, about 320 amino acids to about 380 amino acids, about 320 amino acids to about 360 amino acids, about 320 amino acids to about 340 amino acids, about 340 amino acids to about 3000 amino acids, about 340 amino acids to about 2500 amino acids, about 340 amino acids to about 2000 amino acids, about 340 amino acids to about 1500 amino acids, about 340 amino acids to about 1000 amino acids, about 340 amino acids to about 950 amino acids, about 340 amino acids to about 900 amino acids, about 340 amino acids to about 850 amino acids, about 340 amino acids to about 800 amino acids, about 340 amino acids to about 750 amino acids, about 340 amino acids to about 700 amino acids, about 340 amino acids to about 650 amino acids, about 340 amino acids to about 600 amino acids, about 340 amino acids to about 550 amino acids, about 340 amino acids to about 500 amino acids, about 340 amino acids to about 480 amino acids, about 340 amino acids to about 460 amino acids, about 340 amino acids to about 440 amino acids, about 340 amino acids to about 420 amino acids, about 340 amino acids to about 400 amino acids, about 340 amino acids to about 380 amino acids, about 340 amino acids to about 360 amino acids, about 360 amino acids to about 3000 amino acids, about 360 amino acids to about 2500 amino acids, about 360 amino acids to about 2000 amino acids, about 360 amino acids to about 1500 amino acids, about 360 amino acids to about 1000 amino acids, about 360 amino acids to about 950 amino acids, about 360 amino acids to about 900 amino acids, about 360 amino acids to about 850 amino acids, about 360 amino acids to about 800 amino acids, about 360 amino acids to about 750 amino acids, about 360 amino acids to about 700 amino acids, about 360 amino acids to about 650 amino acids, about 360 amino acids to about 600 amino acids, about 360 amino acids to about 550 amino acids, about 360 amino acids to about 500 amino acids, about 360 amino acids to about 480 amino acids, about 360 amino acids to about 460 amino acids, about 360 amino acids to about 440 amino acids, about 360 amino acids to about 420 amino acids, about 360 amino acids to about 400 amino acids, about 360 amino acids to about 380 amino acids, about 380 amino acids to about 3000 amino acids, about 380 amino acids to about 2500 amino acids, about 380 amino acids to about 2000 amino acids, about 380 amino acids to about 1500 amino acids, about 380 amino acids to about 1000 amino acids, about 380 amino acids to about 950 amino acids, about 380 amino acids to about 900 amino acids, about 380 amino acids to about 850 amino acids, about 380 amino acids to about 800 amino acids, about 380 amino acids to about 750 amino acids, about 380 amino acids to about 700 amino acids, about 380 amino acids to about 650 amino acids, about 380 amino acids to about 600 amino acids, about 380 amino acids to about 550 amino acids, about 380 amino acids to about 500 amino acids, about 380 amino acids to about 480 amino acids, about 380 amino acids to about 460 amino acids, about 380 amino acids to about 440 amino acids, about 380 amino acids to about 420 amino acids, about 380 amino acids to about 400 amino acids, about 400 amino acids to about 3000 amino acids, about 400 amino acids to about 2500 amino acids, about 400 amino acids to about 2000 amino acids, about 400 amino acids to about 1500 amino acids, about 400 amino acids to about 1000 amino acids, about 400 amino acids to about 950 amino acids, about 400 amino acids to about 900 amino acids, about 400 amino acids to about 850 amino acids, about 400 amino acids to about 800 amino acids, about 400 amino acids to about 750 amino acids, about 400 amino acids to about 700 amino acids, about 400 amino acids to about 650 amino acids, about 400 amino acids to about 600 amino acids, about 400 amino acids to about 550 amino acids, about 400 amino acids to about 500 amino acids, about 400 amino acids to about 480 amino acids, about 400 amino acids to about 460 amino acids, about 400 amino acids to about 440 amino acids, about 400 amino acids to about 420 amino acids, about 420 amino acids to about 3000 amino acids, about 420 amino acids to about 2500 amino acids, about 420 amino acids to about 2000 amino acids, about 420 amino acids to about 1500 amino acids, about 420 amino acids to about 1000 amino acids, about 420 amino acids to about 950 amino acids, about 420 amino acids to about 900 amino acids, about 420 amino acids to about 850 amino acids, about 420 amino acids to about 800 amino acids, about 420 amino acids to about 750 amino acids, about 420 amino acids to about 700 amino acids, about 420 amino acids to about 650 amino acids, about 420 amino acids to about 600 amino acids, about 420 amino acids to about 550 amino acids, about 420 amino acids to about 500 amino acids, about 420 amino acids to about 480 amino acids, about 420 amino acids to about 460 amino acids, about 420 amino acids to about 440 amino acids, about 440 amino acids to about 3000 amino acids, about 440 amino acids to about 2500 amino acids, about 440 amino acids to about 2000 amino acids, about 440 amino acids to about 1500 amino acids, about 440 amino acids to about 1000 amino acids, about 440 amino acids to about 950 amino acids, about 440 amino acids to about 900 amino acids, about 440 amino acids to about 850 amino acids, about 440 amino acids to about 800 amino acids, about 440 amino acids to about 750 amino acids, about 440 amino acids to about 700 amino acids, about 440 amino acids to about 650 amino acids, about 440 amino acids to about 600 amino acids, about 440 amino acids to about 550 amino acids, about 440 amino acids to about 500 amino acids, about 440 amino acids to about 480 amino acids, about 440 amino acids to about 460 amino acids, about 460 amino acids to about 3000 amino acids, about 460 amino acids to about 2500 amino acids, about 460 amino acids to about 2000 amino acids, about 460 amino acids to about 1500 amino acids, about 460 amino acids to about 1000 amino acids, about 460 amino acids to about 950 amino acids, about 460 amino acids to about 900 amino acids, about 460 amino acids to about 850 amino acids, about 460 amino acids to about 800 amino acids, about 460 amino acids to about 750 amino acids, about 460 amino acids to about 700 amino acids, about 460 amino acids to about 650 amino acids, about 460 amino acids to about 600 amino acids, about 460 amino acids to about 550 amino acids, about 460 amino acids to about 500 amino acids, about 460 amino acids to about 480 amino acids, about 480 amino acids to about 3000 amino acids, about 480 amino acids to about 2500 amino acids, about 480 amino acids to about 2000 amino acids, about 480 amino acids to about 1500 amino acids, about 480 amino acids to about 1000 amino acids, about 480 amino acids to about 950 amino acids, about 480 amino acids to about 900 amino acids, about 480 amino acids to about 850 amino acids, about 480 amino acids to about 800 amino acids, about 480 amino acids to about 750 amino acids, about 480 amino acids to about 700 amino acids, about 480 amino acids to about 650 amino acids, about 480 amino acids to about 600 amino acids, about 480 amino acids to about 550 amino acids, about 480 amino acids to about 500 amino acids, about 500 amino acids to about 3000 amino acids, about 500 amino acids to about 2500 amino acids, about 500 amino acids to about 2000 amino acids, about 500 amino acids to about 1500 amino acids, about 500 amino acids to about 1000 amino acids, about 500 amino acids to about 950 amino acids, about 500 amino acids to about 900 amino acids, about 500 amino acids to about 850 amino acids, about 500 amino acids to about 800 amino acids, about 500 amino acids to about 750 amino acids, about 500 amino acids to about 700 amino acids, about 500 amino acids to about 650 amino acids, about 500 amino acids to about 600 amino acids, about 500 amino acids to about 550 amino acids, about 550 amino acids to about 3000 amino acids, about 550 amino acids to about 2500 amino acids, about 550 amino acids to about 2000 amino acids, about 550 amino acids to about 1500 amino acids, about 550 amino acids to about 1000 amino acids, about 550 amino acids to about 950 amino acids, about 550 amino acids to about 900 amino acids, about 550 amino acids to about 850 amino acids, about 550 amino acids to about 800 amino acids, about 550 amino acids to about 750 amino acids, about 550 amino acids to about 700 amino acids, about 550 amino acids to about 650 amino acids, about 550 amino acids to about 600 amino acids, about 600 amino acids to about 3000 amino acids, about 600 amino acids to about 2500 amino acids, about 600 amino acids to about 2000 amino acids, about 600 amino acids to about 1500 amino acids, about 600 amino acids to about 1000 amino acids, about 600 amino acids to about 950 amino acids, about 600 amino acids to about 900 amino acids, about 600 amino acids to about 850 amino acids, about 600 amino acids to about 800 amino acids, about 600 amino acids to about 750 amino acids, about 600 amino acids to about 700 amino acids, about 600 amino acids to about 650 amino acids, about 650 amino acids to about 3000 amino acids, about 650 amino acids to about 2500 amino acids, about 650 amino acids to about 2000 amino acids, about 650 amino acids to about 1500 amino acids, about 650 amino acids to about 1000 amino acids, about 650 amino acids to about 950 amino acids, about 650 amino acids to about 900 amino acids, about 650 amino acids to about 850 amino acids, about 650 amino acids to about 800 amino acids, about 650 amino acids to about 750 amino acids, about 650 amino acids to about 700 amino acids, about 700 amino acids to about 3000 amino acids, about 700 amino acids to about 2500 amino acids, about 700 amino acids to about 2000 amino acids, about 700 amino acids to about 1500 amino acids, about 700 amino acids to about 1000 amino acids, about 700 amino acids to about 950 amino acids, about 700 amino acids to about 900 amino acids, about 700 amino acids to about 850 amino acids, about 700 amino acids to about 800 amino acids, about 700 amino acids to about 750 amino acids, about 750 amino acids to about 3000 amino acids, about 750 amino acids to about 2500 amino acids, about 750 amino acids to about 2000 amino acids, about 750 amino acids to about 1500 amino acids, about 750 amino acids to about 1000 amino acids, about 750 amino acids to about 950 amino acids, about 750 amino acids to about 900 amino acids, about 750 amino acids to about 850 amino acids, about 750 amino acids to about 800 amino acids, about 800 amino acids to about 3000 amino acids, about 800 amino acids to about 2500 amino acids, about 800 amino acids to about 2000 amino acids, about 800 amino acids to about 1500 amino acids, about 800 amino acids to about 1000 amino acids, about 800 amino acids to about 950 amino acids, about 800 amino acids to about 900 amino acids, about 800 amino acids to about 850 amino acids, about 850 amino acids to about 3000 amino acids, about 850 amino acids to about 2500 amino acids, about 850 amino acids to about 2000 amino acids, about 850 amino acids to about 1500 amino acids, about 850 amino acids to about 1000 amino acids, about 850 amino acids to about 950 amino acids, about 850 amino acids to about 900 amino acids, about 900 amino acids to about 3000 amino acids, about 900 amino acids to about 2500 amino acids, about 900 amino acids to about 2000 amino acids, about 900 amino acids to about 1500 amino acids, about 900 amino acids to about 1000 amino acids, about 900 amino acids to about 950 amino acids, about 950 amino acids to about 3000 amino acids, about 950 amino acids to about 2500 amino acids, about 950 amino acids to about 2000 amino acids, about 950 amino acids to about 1500 amino acids, about 950 amino acids to about 1000 amino acids, about 1000 amino acids to about 3000 amino acids, about 1000 amino acids to about 2500 amino acids, about 1000 amino acids to about 2000 amino acids, about 1000 amino acids to about 1500 amino acids, about 1500 amino acids to about 3000 amino acids, about 1500 amino acids to about 2500 amino acids, about 1500 amino acids to about 2000 amino acids, about 2000 amino acids to about 3000 amino acids, about 2000 amino acids to about 2500 amino acids, or about 2500 amino acids to about 3000 amino acids.

In some embodiments of any of the single-chain chimeric polypeptides described herein, the first target-binding domain (e.g., any of the exemplary target-binding domains described herein or known in the art) and the soluble tissue factor domain (e.g., any of the exemplary soluble tissue factor domains described herein) directly abut each other. In some embodiments of any of the single-chain chimeric polypeptides described herein, the single-chain chimeric polypeptide further comprises a linker sequence (e.g., any of the exemplary linker sequences described herein or known in the art) between the first target-binding domain (e.g., any of the exemplary target-binding domains described herein or known in the art) and the soluble tissue factor domain (e.g., any of the exemplary soluble tissue factor domains described herein). In some embodiments of any of the single-chain chimeric polypeptides described herein, the soluble tissue factor domain (e.g., any of the exemplary soluble tissue factor domains described herein) and the second target-binding domain (e.g., any of the exemplary target-binding domains described herein or known in the art) directly abut each other. In some embodiments of any of the single-chain chimeric polypeptides described herein, the single-chain chimeric polypeptide further comprises a linker sequence (e.g., any of the exemplary linker sequences described herein or known in the art) between the soluble tissue factor domain (e.g., any of the exemplary soluble tissue factor domains described herein) and the second target-binding domain (e.g., any of the exemplary target-binding domains described herein or known in the art).

In some embodiments of any of the single-chain chimeric polypeptides described herein, the first target-binding domain (e.g., any of the exemplary target-binding domains described herein or known in the art) and the second target-binding domain (e.g., any of the exemplary target-binding domains described herein or known in the art) directly abut each other. In some embodiments of any of the single-chain chimeric polypeptides described herein, the single-chain chimeric polypeptide further comprises a linker sequence (e.g., any of the exemplary linker sequences described herein or known in the art) between the first target-binding domain (e.g., any of the exemplary target-binding domains described herein or known in the art) and the second target-binding domain (e.g., any of the exemplary target-binding domains described herein or known in the art). In some embodiments of any of the single-chain chimeric polypeptides described herein, the second target-binding domain (e.g., any of the exemplary target-binding domains described herein or known in the art) and the soluble tissue factor domain (e.g., any of the exemplary soluble tissue factor domains described herein) directly abut each other. In some embodiments of any of the single-chain chimeric polypeptides described herein, the single-chain chimeric polypeptide further comprises a linker sequence (e.g., any of the exemplary linker sequences described herein or known in the art) between the second target-binding domain (e.g., any of the exemplary target-binding domains described herein or known in the art) and the soluble tissue factor domain (e.g., any of the exemplary soluble tissue factor domains described herein or known in the art).

In some embodiments, a single-chain chimeric polypeptide can include a sequence that is at least 70% identical (e.g., at least 75% identical, at least 80% identical, at least 85% identical, at least 90% identical, at least 95% identical, at least 99% identical, or 100% identical) to (SEQ ID NO: 85)
QIVLTQSPAIMSASPGEKVTMTCSASSSVSYMNWYQQKSGTSPKRWIYDTS

KLASGVPAHFRGSGSGTSYSLTISGMEAEDAATYYCQQWSSNPFTFGSGTK

LEINRGGGGSGGGGSGGGGSOVQLQQSGAELARPGASVKMSCKASGYTFTR

YTMHWVKQRPGQGLEWIGYINPSRGYTNYNQKFKDKATLTTDKSSSTAYMQ

LSSLTSEDSAVYYCARYYDDHYCLDYWGQGTTLTVSSSGTTNTVAAYNLTW

KSTNFKTILEWEPKPVNQVYTVQISTKSGDWKSKCFYTTDTECDLTDEIVK

DVKQTYLARVFSYPAGNVESTGSAGEPLYENSPEFTPYLETNLGQPTIQSF

EQVGTKVNVTVEDERTLVRRNNTFLSLRDVFGKDLIYTLYYWKSSSSGKKT

AKTNTNEFLIDVDKGENYCFSVQAVIPSRTVNRKSTDSPVECMGQEKGEFR

EVQLQQSGPELVKPGASVKMSCKASGYTFTSYVIQWVKQKPGQGLEWIGSI

NPYNDYTKYNEKFKGKATLTSDKSSITAYMEFSSLTSEDSALYYCARWGDG

NYWGRGTTLTVSSGGGGSGGGGSGGGGSDIEMTQSPAIMSASLGERVTMTC

TASSSVSSSYFHWYQQKPGSSPKLCIYSTSNLASGVPPRFSGSGSTSYSLT

ISSMEAEDAATYFCHQYHRSPTFGGGTKLETKR.

In some embodiments, a single-chain chimeric polypeptide is encoded by a nucleic acid that includes a sequence that is at least 70% identical (e.g., at least 75% identical, at least 80% identical, at least 85% identical, at least 90% identical, at least 95% identical, at least 99% identical, or 100% identical) to (SEQ ID NO: 86)
CAGATCGTGCTGACCCAAAGCCCCGCCATCATGAGCGCTAGCCCCGGTGAG

AAGGTGACCATGACATGCTCCGCTTCCAGCTCCGTGTCCTACATGAACTGG

TATCAGCAGAAAAGCGGAACCAGCCCCAAAAGGTGGATCTACGACACCAGC

```
AAGCTGGCCTCCGGAGTGCCCGCTCATTTCCGGGGCTCTGGATCCGGCACC
AGCTACTCTTTAACCATTTCCGGCATGGAAGCTGAAGACGCTGCCACCTAC
TATTGCCAGCAATGGAGCAGCAACCCCTTCACATTCGGATCTGGCACCAAG
CTCGAAATCAATCGTGGAGGAGGTGGCAGCGGCGGCGGTGGATCCGGCGGA
GGAGGAAGCCAAGTTCAACTCCAGCAGAGCGGCGCTGAACTGGCCCGGCCC
GGCGCCTCCGTCAAGATGAGCTGCAAGGCTTCCGGCTATACATTTACTCGT
TACACAATGCATTGGGTCAAGCAGAGGCCCGGTCAAGGTTTAGAGTGGATC
GGATATATCAACCCTTCCCGGGGCTACACCAACTATAACCAAAAGTTCAAG
GATAAAGCCACTTTAACCACTGACAAGAGCTCCTCCACCGCCTACATGCAG
CTGTCCTCTTTAACCAGCGAGGACTCCGCTGTTTACTACTGCGCTAGGTAT
TACGACGACCACTACTGTTTAGACTATTGGGGACAAGGTACCACTTTAACC
GTCAGCAGCTCCGGCACCACCAATACCGTGGCCGCTTATAACCTCACATGG
AAGAGCACCAACTTCAAGACAATTCTGGAATGGGAACCCAAGCCCGTCAAT
CAAGTTTACACCGTGCAGATCTCCACCAAATCCGGAGACTGGAAGAGCAAG
TGCTTCTACACAACAGACACCGAGTGTGATTTAACCGACGAAATCGTCAAG
GACGTCAAGCAAACCTATCTGGCTCGGGTCTTTTCCTACCCCGCTGGCAAT
GTCGAGTCCACCGGCTCCGCTGGCGAGCCTCTCTACGAGAATTCCCCCGAA
TTCACCCCTTATTTAGAGACCAATTTAGGCCAGCCTACCATCCAGAGCTTC
GAGCAAGTTGGCACCAAGGTGAACGTCACCGTCGAGGATGAAAGGACTTTA
GTGCGGCGGAATAACACATTTTTATCCCTCCGGGATGTGTTCGGCAAAGAC
CTCATCTACACACTGTACTATTGGAAGTCCAGCTCCTCCGGCAAAAAGACC
GCTAAGACCAACACCAACGAGTTTTTAATTGACGTGGACAAAGGCGAGAAC
TACTGCTTCAGCGTGCAAGCCGTGATCCCTTCTCGTACCGTCAACCGGAAG
AGCACAGATTCCCCCGTTGAGTGCATGGGCCAAGAAAAGGGCGAGTTCCGG
GAGGTCCAGCTGCAGCAGAGCGGACCCGAACTCGTGAAACCCGGTGCTTCC
GTGAAAATGTCTTGTAAGGCCAGCGGATACACCTTCACCTCCTATGTGATC
CAGTGGGTCAAACAGAAGCCCGGACAAGGTCTCGAGTGGATCGGCAGCATC
AACCCTTACAACGACTATACCAAATACAACGAGAAGTTTAAGGGAAAGGCT
ACTTTAACCTCCGACAAAAGCTCCATCACAGCCTACATGGAGTTCAGCTCT
TTAACATCCGAGGACAGCGCTCTGTACTATTGCGCCCGTGGGGCGACGGC
AATTACTGGGGACGGGGCACAACACTGACCGTGAGCAGCGGAGGCGGAGGC
TCCGGCGGAGGCGGATCTGGCGGTGGCGGCTCCGACATCGAGATGACCCAG
TCCCCCGCTATCATGTCCGCCTCTTTAGGCGAGCGGGTCACAATGACTTGT
ACAGCCTCCTCCAGCGTCTCCTCCTCCTACTTCCATTGGTACCAACAGAAA
CCCGGAAGCTCCCCTAAACTGTGCATCTACAGCACCAGCAATCTCGCCAGC
GGCGTGCCCCCTAGGTTTTCCGGAAGCGGAAGCACCAGCTACTCTTTAACC
ATCTCCTCCATGGAGGCTGAGGATGCCGCCACCTACTTTTGTCACCAGTAC
CACCGGTCCCCACCTTCGGAGGCGGCACCAAACTGGAGACAAAGAGG.
```

In some embodiments, a single-chain chimeric polypeptide can include a sequence that is at least 70% identical (e.g., at least 75% identical, at least 80% identical, at least 85% identical, at least 90% identical, at least 95% identical, at least 99% identical, or 100% identical) to (SEQ ID NO: 87)
MKWVTFISLLFLFSSAYSQIVLTQSPAIMSASPGEKVTMTCSASSSVSYMN

WYQQKSGTSPKRWIYDTSKLASGVPAHFRGSGSGTSYSLTISGMEAEDAAT

YYCQQWSSNPFTFGSGTKLEINRGGGSGGGGSGGGGSQVQLQQSGAELAR

PGASVKMSCKASGYTFTRYTMHWVKQRPGQGLEWIGYINPSRGYTNYNQKF

KDKATLTTDKSSSTAYMQLSSLTSEDSAVYYCARYYDDHYCLDYWGQGTTL

TVSSSGTTNTVAAYNLTWKSTNFKTILEWEPKPVNQVYTVQISTKSGDWKS

KCFYTTDTECDLTDEIVKDVKQTYLARVFSYPAGNVESTGSAGEPLYENSP

EFTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVNR

KSTDSPVECMGQEKGEFREVQLQQSGPELVKPGASVKMSCKASGYTFTSYV

IQWVKQKPGQGLEWIGSINPYNDYTKYNEKFKGKATLTSDKSSITAYMEFS

SLTSEDSALYYCARWGDGNYWGRGTTLTVSSGGGGSGGGGSGGGGSDIEMT

QSPAIMSASLGERVTMTCTASSSVSSSYFHWYQQKPGSSPKLCIYSTSNLA

SGVPPRFSGSGSTSYSLTISSMEAEDAATYFCHQYHRSPTFGGGTKLETK

R.

In some embodiments, a single-chain chimeric polypeptide is encoded by a nucleic acid that includes a sequence that is at least 70% identical (e.g., at least 75% identical, at least 80% identical, at least 85% identical, at least 90% identical, at least 95% identical, at least 99% identical, or 100% identical) to (SEQ ID NO: 88)
ATGAAGTGGGTGACCTTCATCAGCTTATTATTTTTATTCAGCTCCGCCTA

TTCCCAGATCGTGCTGACCCAAAGCCCCGCCATCATGAGCGCTAGCCCCG

GTGAGAAGGTGACCATGACATGCTCCGCTTCCAGCTCCGTGTCCTACATG

AACTGGTATCAGCAGAAAAGCGGAACCAGCCCCAAAAGGTGGATCTACGA

CACCAGCAAGCTGGCCTCCGGAGTGCCCGCTCATTTCCGGGGCTCTGGAT

CCGGCACCAGCTACTCTTTAACCATTTCCGGCATGGAAGCTGAAGACGCT

GCCACCTACTATTGCCAGCAATGGAGCAGCAACCCCTTCACATTCGGATC

TGGCACCAAGCTCGAAATCAATCGTGGAGGAGGTGGCAGCGGCGGCGGTG

GATCCGGCGGAGGAGGAAGCCAAGTTCAACTCCAGCAGAGCGGCGCTGAA

CTGGCCCGGCCCGGCGCCTCCGTCAAGATGAGCTGCAAGGCTTCCGGCTA

TACATTTACTCGTTACACAATGCATTGGGTCAAGCAGAGGCCCGGTCAAG

GTTTAGAGTGGATCGGATATATCAACCCTTCCCGGGGCTACACCAACTAT

AACCAAAAGTTCAAGGATAAAGCCACTTTAACCACTGACAAGAGCTCCTC

CACCGCCTACATGCAGCTGTCCTCTTTAACCAGCGAGGACTCCGCTGTTT

ACTACTGCGCTAGGTATTACGACGACCACTACTGTTTAGACTATTGGGGA

CAAGGTACCACTTTAACCGTCAGCAGCTCCGGCACCACCAATACCGTGGC

CGCTTATAACCTCACATGGAAGAGCACCAACTTCAAGACAATTCTGGAAT

GGGAACCCAAGCCCGTCAATCAAGTTTACACCGTGCAGATCTCCACCAAA

```
TCCGGAGACTGGAAGAGCAAGTGCTTCTACACAACAGACACCGAGTGTGA

TTTAACCGACGAAATCGTCAAGGACGTCAAGCAAACCTATCTGGCTCGGG

TCTTTTCCTACCCCGCTGGCAATGTCGAGTCCACCGGCTCCGCTGGCGAG

CCTCTCTACGAGAATTCCCCCGAATTCACCCCTTATTTAGAGACCAATTT

AGGCCAGCCTACCATCCAGAGCTTCGAGCAAGTTGGCACCAAGGTGAACG

TCACCGTCGAGGATGAAAGGACTTTAGTGCGGCGGAATAACACATTTTTA

TCCCTCCGGGATGTGTTCGGCAAAGACCTCATCTACACACTGTACTATTG

GAAGTCCAGCTCCTCCGGCAAAAAGACCGCTAAGACCAACACCAACGAGT

TTTTAATTGACGTGGACAAAGGCGAGAACTACTGCTTCAGCGTGCAAGCC

GTGATCCCTTCTCGTACCGTCAACCGGAAGAGCACAGATTCCCCCGTTGA

GTGCATGGGCCAAGAAAAGGGCGAGTTCCGGGAGGTCCAGCTGCAGCAGA

GCGGACCCGAACTCGTGAAACCCGGTGCTTCCGTGAAAATGTCTTGTAAG

GCCAGCGGATACACCTTCACCTCCTATGTGATCCAGTGGGTCAAACAGAA

GCCCGGACAAGGTCTCGAGTGGATCGGCAGCATCAACCCTTACAACGACT

ATACCAAATACAACGAGAAGTTTAAGGGAAAGGCTACTTTAACCTCCGAC

AAAAGCTCCATCACAGCCTACATGGAGTTCAGCTCTTTAACATCCGAGGA

CAGCGCTCTGTACTATTGCGCCCGGTGGGCGACGGCAATTACTGGGGAC

GGGGCACAACACTGACCGTGAGCAGCGGAGGCGGAGGCTCCGGCGGAGGC

GGATCTGGCGGTGGCGGCTCCGACATCGAGATGACCCAGTCCCCCGCTAT

CATGTCCGCCTCTTTAGGCGAGCGGGTCACAATGACTTGTACAGCCTCCT

CCAGCGTCTCCTCCTCCTACTTCCATTGGTACCAACAGAAACCCGGAAGC

TCCCCTAAACTGTGCATCTACAGCACCAGCAATCTCGCCAGCGGCGTGCC

CCCTAGGTTTTCCGGAAGCGGAAGCACCAGCTACTCTTTAACCATCTCCT

CCATGGAGGCTGAGGATGCCGCCACCTACTTTTGTCACCAGTACCACCGG

TCCCCCACCTTCGGAGGCGGCACCAAACTGGAGACAAAGAGG.
```

In some embodiments, a single-chain chimeric polypeptide can include a sequence that is at least 70% identical (e.g., at least 75% identical, at least 80% identical, at least 85% identical, at least 90% identical, at least 95% identical, at least 99% identical, or 100% identical) to (SEQ ID NO: 89)
```
VQLQQSGPELVKPGASVKMSCKASGYTFTSYVIQWVKQKPGQGLEWIGSI

NPYNDYTKYNEKFKGKATLTSDKSSITAYMEFSSLTSEDSALYYCARWGD

GNYWGRGTTLTVSSGGGGSGGGGSGGGGSDIEMTQSPAIMSASLGERVTM

TCTASSSVSSSYFHWYQQKPGSSPKLCIYSTSNLASGVPPRFSGSGSTSY

SLTISSMEAEDAATYFCHQYHRSPTFGGGTKLETKRSGTTNTVAAYNLTW

KSTNFKTILEWEPKPVNQVYTVQISTKSGDWKSKCFYTTDTECDLTDEIV

KDVKQTYLARVFSYPAGNVESTGSAGEPLYENSPEFTPYLETNLGQPTIQ

SFEQVGTKVNVTVEDERTLVRRNNTFLSLRDVFGKDLIYTLYYWKSSSSG

KKTAKTNTNEFLIDVDKGENYCFSVQAVIPSRTVNRKSTDSPVECMGQEK

GEFREQIVLTQSPAIMSASPGEKVTMTCSASSSVSYMNWYQQKSGTSPKR

WIYDTSKLASGVPAHFRGSGSGTSYSLTISGMEAEDAATYYCQQWSSNPF
```

```
TFGSGTKLEINRGGGGSGGGGSGGGGSQVQLQQSGAELARPGASVKMSCK

ASGYTFTRYTMHWVKQRPGQGLEWIGYINPSRGYTNYNQKFKDKATLTTD

KSSSTAYMQLSSLTSEDSAVYYCARYYDDHYCLDYWGQGTTLTVSS.
```

In some embodiments, a single-chain chimeric polypeptide is encoded by a nucleic acid that includes a sequence that is at least 70% identical (e.g., at least 75% identical, at least 80% identical, at least 85% identical, at least 90% identical, at least 95% identical, at least 99% identical, or 100% identical) to (SEQ ID NO: 90)
```
GTGCAGCTGCAGCAGTCCGGACCCGAACTGGTCAAGCCCGGTGCCTCCGT

GAAAATGTCTTGTAAGGCTTCTGGCTACACCTTTACCTCCTACGTCATCC

AATGGGTGAAGCAGAAGCCCGGTCAAGGTCTCGAGTGGATCGGCAGCATC

AATCCCTACAACGATTACACCAAGTATAACGAAAAGTTTAAGGGCAAGGC

CACTCTGACAAGCGACAAGAGCTCCATTACCGCCTACATGGAGTTTTCCT

CTTTAACTTCTGAGGACTCCGCTTTATACTATTGCGCTCGTTGGGGCGAT

GGCAATTATTGGGGCCGGGGAACTACTTTAACAGTGAGCTCCGGCGGCGG

CGGAAGCGGAGGTGGAGGATCTGGCGGTGGAGGCAGCGACATCGAGATGA

CACAGTCCCCCGCTATCATGAGCGCCTCTTTAGGAGAACGTGTGACCATG

ACTTGTACAGCTTCCTCCAGCGTGAGCAGCTCCTATTTCCACTGGTACCA

GCAGAAACCCGGCTCCTCCCCTAAACTGTGTATCTACTCCACAAGCAATT

TAGCTAGCGGCGTGCCTCCTCGTTTTAGCGGCTCCGGCAGCACCTCTTAC

TCTTTAACCATTAGCTCTATGGAGGCCGAAGATGCCGCCACATACTTTTG

CCATCAGTACCACCGGTCCCCTACCTTTGGCGGAGGCACAAAGCTGGAGA

CCAAGCGGAGCGGCACCACCAACACAGTGGCCGCCTACAATCTGACTTGG

AAATCCACCAACTTCAAGACCATCCTCGAGTGGGAGCCCAAGCCCGTTAA

TCAAGTTTATACCGTGCAGATTTCCACCAAGAGCGGCGACTGGAAATCCA

AGTGCTTCTATACCACAGACACCGAGTGCGATCTCACCGACGAGATCGTC

AAAGACGTGAAGCAGACATATTTAGCTAGGGTGTTCTCCTACCCCGCTGG

AAACGTGGAGAGCACCGGATCCGCTGGAGAGCCTTTATACGAGAACTCCC

CCGAATTCACCCCCTATCTGGAAACCAATTTAGGCCAGCCCACCATCCAG

AGCTTCGAACAAGTTGGCACAAAGGTGAACGTCACCGTCGAAGATGAGAG

GACTTTAGTGCGGAGGAACAATACATTTTTATCCTTACGTGACGTCTTCG

GCAAGGATTTAATCTACACACTGTATTACTGGAAGTCTAGCTCCTCCGGC

AAGAAGACCGCCAAGACCAATACCAACGAATTTTTAATTGACGTGGACAA

GGGCGAGAACTACTGCTTCTCCGTGCAAGCTGTGATCCCCTCCCGGACAG

TGAACCGGAAGTCCACCGACTCCCCCGTGGAGTGCATGGGCCAAGAGAAG

GGAGAGTTTCGTGAGCAGATCGTGCTGACCCAGTCCCCCGCTATTATGAG

CGCTAGCCCCGGTGAAAAGGTGACTATGACATGCAGCGCCAGCTCTTCCG

TGAGCTACATGAACTGGTATCAGCAGAAGTCCGGCACCAGCCCTAAAAGG

TGGATCTACGACACCAGCAAGCTGGCCAGCGGCGTCCCCGCTCACTTTCG

GGGCTCCGGCTCCGGAACAAGCTACTCTCTGACCATCAGCGGCATGGAAG
```

-continued
CCGAGGATGCCGCTACCTATTACTGTCAGCAGTGGAGCTCCAACCCCTTC

ACCTTTGGATCCGGCACCAAGCTCGAGATTAATCGTGGAGGCGGAGGTAG

CGGAGGAGGCGGATCCGGCGGTGGAGGTAGCCAAGTTCAGCTCCAGCAAA

GCGGCGCCGAACTCGCTCGGCCCGGCGCTTCCGTGAAGATGTCTTGTAAG

GCCTCCGGCTATACCTTCACCCGGTACACAATGCACTGGGTCAAGCAACG

GCCCGGTCAAGGTTTAGAGTGGATTGGCTATATCAACCCCTCCCGGGGCT

ATACCAACTACAACCAGAAGTTCAAGGACAAAGCCACCCTCACCACCGAC

AAGTCCAGCAGCACCGCTTACATGCAGCTGAGCTCTTTAACATCCGAGGA

TTCCGCCGTGTACTACTGCGCTCGGTACTACGACGATCATTACTGCCTCG

ATTACTGGGGCCAAGGTACCACCTTAACAGTCTCCTCC.

In some embodiments, a single-chain chimeric polypeptide can include a sequence that is at least 70% identical (e.g., at least 75% identical, at least 80% identical, at least 85% identical, at least 90% identical, at least 95% identical, at least 99% identical, or 100% identical) to (SEQ ID NO: 91)
MKWVTFISLLFLFSSAYSVQLQQSGPELVKPGASVKMSCKASGYTFTSYV

IQWVKQKPGQGLEWIGSINPYNDYTKYNEKFKGKATLTSDKSSITAYMEF

SSLTSEDSALYYCARWGDGNYWGRGTTLTVSSGGGGSGGGGSGGGGSDIE

MTQSPAIMSASLGERVTMTCTASSSVSSSYFHWYQQKPGSSPKLCIYSTS

NLASGVPPRFSGSGSTSYSLTISSMEAEDAATYFCHQYHRSPTFGGGTKL

ETKRSGTTNTVAAYNLTWKSTNFKTILEWEPKPVNQVYTVQISTKSGDWK

SKCFYTTDTECDLTDEIVKDVKQTYLARVFSYPAGNVESTGSAGEPLYEN

SPEFTPYLETNLGQPTIQSFEQVGTKVNVTVEDERTLVRRNNTFLSLRDV

FGKDLIYTLYYWKSSSSGKKTAKTNTNEFLIDVDKGENYCFSVQAVIPSR

TVNRKSTDSPVECMGQEKGEFREQIVLTQSPAIMSASPGEKVTMTCSASS

SVSYMNWYQQKSGTSPKRWIYDTSKLASGVPAHFRGSGSGTSYSLTISGM

EAEDAATYYCQQWSSNPFTFGSGTKLEINRGGGGSGGGGSGGGGSQVQLQ

QSGAELARPGASVKMSCKASGYTFTRYTMHWVKQRPGQGLEWIGYINPSR

GYTNYNQKFKDKATLTTDKSSSTAYMQLSSLTSEDSAVYYCARYYDDHYC

LDYWGQGTTLTVSS.

In some embodiments, a single-chain chimeric polypeptide is encoded by a nucleic acid that includes a sequence that is at least 70% identical (e.g., at least 75% identical, at least 80% identical, at least 85% identical, at least 90% identical, at least 95% identical, at least 99% identical, or 100% identical) to (SEQ ID NO: 92)
ATGAAATGGGTCACCTTCATCTCTTTACTGTTTTTATTTAGCAGCGCCTA

CAGCGTGCAGCTGCAGCAGTCCGGACCCGAACTGGTCAAGCCCGGTGCCT

CCGTGAAAATGTCTTGTAAGGCTTCTGGCTACACCTTTACCTCCTACGTC

ATCCAATGGGTGAAGCAGAAGCCCGGTCAAGGTCTCGAGTGGATCGGCAG

CATCAATCCCTACAACGATTACACCAAGTATAACGAAAAGTTTAAGGGCA

AGGCCACTCTGACAAGCGACAAGAGCTCCATTACCGCCTACATGGAGTTT

TCCTCTTTAACTTCTGAGGACTCCGCTTTATACTATTGCGCTCGTTGGGG

CGATGGCAATTATTGGGGCCGGGGAACTACTTTAACAGTGAGCTCCGGCG

GCGGCGGAAGCGGAGGTGGAGGATCTGGCGGTGGAGGCAGCGACATCGAG

ATGACACAGTCCCCCGCTATCATGAGCGCCTCTTTAGGAGAACGTGTGAC

CATGACTTGTACAGCTTCCTCCAGCGTGAGCAGCTCCTATTTCCACTGGT

ACCAGCAGAAACCCGGCTCCTCCCCTAAACTGTGTATCTACTCCACAAGC

AATTTAGCTAGCGGCGTGCCTCCTCGTTTTAGCGGCTCCGGCAGCACCTC

TTACTCTTTAACCATTAGCTCTATGGAGGCCGAAGATGCCGCCACATACT

TTTGCCATCAGTACCACCGGTCCCCTACCTTTGGCGGAGGCACAAAGCTG

GAGACCAAGCGGAGCGGCACCACCAACACAGTGGCCGCCTACAATCTGAC

TTGGAAATCCACCAACTTCAAGACCATCCTCGAGTGGGAGCCCAAGCCCG

TTAATCAAGTTTATACCGTGCAGATTTCCACCAAGAGCGGCGACTGGAAA

TCCAAGTGCTTCTATACCACAGACACCGAGTGCGATCTCACCGACGAGAT

CGTCAAAGACGTGAAGCAGACATATTTAGCTAGGGTGTTCTCCTACCCCG

CTGGAAACGTGGAGAGCACCGGATCCGCTGGAGAGCCTTTATACGAGAAC

TCCCCCGAATTCACCCCCTATCTGGAAACCAATTTAGGCCAGCCCACCAT

CCAGAGCTTCGAACAAGTTGGCACAAAGGTGAACGTCACCGTCGAAGATG

AGAGGACTTTAGTGCGGAGGAACAATACATTTTTATCCTTACGTGACGTC

TTCGGCAAGGATTTAATCTACACACTGTATTACTGGAAGTCTAGCTCCTC

CGGCAAGAAGACCGCCAAGACCAATACCAACGAATTTTTAATTGACGTGG

ACAAGGGCGAGAACTACTGCTTCTCCGTGCAAGCTGTGATCCCCTCCCGG

ACAGTGAACCGGAAGTCCACCGACTCCCCCGTGGAGTGCATGGGCCAAGA

GAAGGGAGAGTTTCGTGAGCAGATCGTGCTGACCCAGTCCCCCGCTATTA

TGAGCGCTAGCCCCGGTGAAAAGGTGACTATGACATGCAGCGCCAGCTCT

TCCGTGAGCTACATGAACTGGTATCAGCAGAAGTCCGGCACCAGCCCTAA

AAGGTGGATCTACGACACCAGCAAGCTGGCCAGCGGCGTCCCCGCTCACT

TTCGGGGCTCCGGCTCCGGAACAAGCTACTCTCTGACCATCAGCGGCATG

GAAGCCGAGGATGCCGCTACCTATTACTGTCAGCAGTGGAGCTCCAACCC

CTTCACCTTTGGATCCGGCACCAAGCTCGAGATTAATCGTGGAGGCGGAG

GTAGCGGAGGAGGCGGATCCGGCGGTGGAGGTAGCCAAGTTCAGCTCCAG

CAAAGCGGCGCCGAACTCGCTCGGCCCGGCGCTTCCGTGAAGATGTCTTG

TAAGGCCTCCGGCTATACCTTCACCCGGTACACAATGCACTGGGTCAAGC

AACGGCCCGGTCAAGGTTTAGAGTGGATTGGCTATATCAACCCCTCCCGG

GGCTATACCAACTACAACCAGAAGTTCAAGGACAAAGCCACCCTCACCAC

CGACAAGTCCAGCAGCACCGCTTACATGCAGCTGAGCTCTTTAACATCCG

AGGATTCCGCCGTGTACTACTGCGCTCGGTACTACGACGATCATTACTGC

CTCGATTACTGGGGCCAAGGTACCACCTTAACAGTCTCCTCC.

Some embodiments of any of the single-chain chimeric polypeptides described herein can further include one or more (e.g., two, three, four, five, six, seven, eight, nine, or ten) additional target-binding domains (e.g., any of the exemplary target-binding domains described herein or known in the art) at its N- and/or C-terminus.

In some embodiments, the single-chain chimeric polypeptides can include one or more (e.g., two, three, four, five, six, seven, eight, nine, or ten) additional target-binding domains (e.g., any of the exemplary target-binding domains described herein or known in the art) at its N-terminus. In some embodiments, one of the one or more additional target-binding domains (e.g., any of the exemplary target-binding domains described herein or known in the art) at the N-terminus of the single-chain chimeric polypeptide can directly abut the first target-binding domain (e.g., any of the exemplary target-binding domains described herein or known in the art), the second target-binding domain (e.g., any of the exemplary target-binding domains described herein or known in the art), or the soluble tissue factor domain (e.g., any of the exemplary soluble tissue factor domains described herein). In some embodiments, the single-chain chimeric polypeptide further includes a linker sequence (e.g., any of the exemplary linker sequences described herein or known in the art) between one of the at least one additional target-binding domains (e.g., any of the exemplary target-binding domains described herein or known in the art) at the N-terminus of the single-chain chimeric polypeptide and the first target-binding domain (e.g., any of the exemplary target-binding domains described herein or known in the art), the second target-binding domain (e.g., any of the exemplary target-binding domains described herein or known in the art), or the soluble tissue factor domain (e.g., any of the exemplary soluble tissue factor domains described herein).

In some embodiments of any of the single-chain chimeric polypeptides described herein, the single-chain chimeric polypeptide includes one or more (e.g., two, three, four, five, six, seven, eight, nine, or ten) additional target-binding domains (e.g., any of the exemplary target-binding domains described herein or known in the art) at its C-terminus. In some embodiments, one of the one or more additional target-binding domains (e.g., any of the exemplary target-binding domains described herein or known in the art) at the C-terminus of the single-chain chimeric polypeptide directly abuts the first target-binding domain (e.g., any of the exemplary target-binding domains described herein or known in the art), the second target-binding domain (e.g., any of the exemplary target-binding domains described herein or known in the art), or the soluble tissue factor domain (e.g., any of the exemplary soluble tissue factor domains described herein or known in the art). In some embodiments, the single-chain chimeric polypeptide further comprises a linker sequence (e.g., any of the exemplary linker sequences described herein or known in the art) between one of the at least one additional target-binding domains (e.g., any of the exemplary target-binding domains described herein or known in the art) at the C-terminus of the single-chain chimeric polypeptide and the first target-binding domain (e.g., any of the exemplary target-binding domains described herein or known in the art), the second target-binding domain (e.g., any of the exemplary target-binding domains described herein or known in the art), or the soluble tissue factor domain (e.g., any of the exemplary soluble tissue factor domains described herein).

In some embodiments of any of the single-chain chimeric polypeptides described herein, the single-chain chimeric polypeptide comprises one or more (e.g., two, three, four, five, six, seven, eight, nine, or ten) additional target binding domains (e.g., any of the exemplary target-binding domains described herein or known in the art) at its N-terminus and its C-terminus. In some embodiments, one of the one or more additional antigen binding domains (e.g., any of the exemplary target-binding domains described herein or known in the art) at the N-terminus of the single-chain chimeric polypeptide directly abuts the first target-binding domain (e.g., any of the exemplary target-binding domains described herein or known in the art), the second target-binding domain (e.g., any of the exemplary target-binding domains described herein or known in the art), or the soluble tissue factor domain (e.g., any of the exemplary soluble tissue factor domains described herein). In some embodiments, the single-chain chimeric polypeptide further includes a linker sequence (e.g., any of the exemplary linker sequences described herein or known in the art) between one of the one or more additional antigen-binding domains (e.g., any of the exemplary target-binding domains described herein or known in the art) at the N-terminus and the first target-binding domain (e.g., any of the exemplary target-binding domains described herein or known in the art), the second target-binding domain (e.g., any of the exemplary target-binding domains described herein or known in the art), or the soluble tissue factor domain (e.g., any of the exemplary soluble tissue factor domains). In some embodiments, one of the one or more additional antigen binding domains (e.g., any of the exemplary target-binding domains described herein or known in the art) at the C-terminus directly abuts the first target-binding domain (e.g., any of the exemplary target-binding domains described herein or known in the art), the second target-binding domain (e.g., any of the exemplary target-binding domains described herein or known in the art), or the soluble tissue factor domain (e.g., any of the exemplary soluble tissue factor domains). In some embodiments, the single-chain chimeric polypeptide further includes a linker sequence (e.g., any of the exemplary linker sequences described herein or known in the art) between one of the one or more additional antigen-binding domains (e.g., any of the exemplary target-binding domains described herein or known in the art) at the C-terminus and the first target-binding domain (e.g., any of the exemplary target-binding domains described herein or known in the art), the second target-binding domain (e.g., any of the exemplary target-binding domains described herein or known in the art), or the soluble tissue factor domain (e.g., any of the exemplary soluble tissue factor domains described herein).

In some embodiments of any of the single-chain chimeric polypeptides described herein, two or more (e.g., three, four, five, six, seven, eight, nine, or ten) of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) bind specifically to the same antigen. In some embodiments, two or more (e.g., three, four, five, six, seven, eight, nine, or ten) of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) bind specifically to the same epitope. In some embodiments, two or more (e.g., three, four, five, six, seven, eight, nine, or ten) of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) include the same amino acid sequence.

In some embodiments of any of the single-chain chimeric polypeptides described herein, the first target-binding domain (e.g., any of the exemplary target-binding domains described herein or known in the art), the second target-binding domain (e.g., any of the exemplary target-binding domains described herein or known in the art), and the one or more (e.g., two, three, four, five, six, seven, eight, nine, or ten) additional target-binding domains (e.g., any of the exemplary target-binding domains described herein or known in the art) each bind specifically to the same antigen. In some embodiments, the first target-binding domain (e.g., any of the exemplary target-binding domains described herein or known in the art), the second target-binding domain (e.g., any of the exemplary target-binding domains described herein or known in the art), and the one or more (e.g., two, three, four, five, six, seven, eight, nine, or ten) additional target-binding domains (e.g., any of the exemplary target-binding domains described herein or known in the art) each bind specifically to the same epitope. In some embodiments, the first target-binding domain, the second target-binding domain, and the one or more (e.g., two, three, four, five, six, seven, eight, nine, or ten) additional target-binding domains each comprise the same amino acid sequence.

In some embodiments of any of the single-chain chimeric polypeptides described herein, the first target-binding domain (e.g., any of the exemplary target-binding domains described herein or known in the art), the second target-binding domain (e.g., any of the exemplary target-binding domains described herein or known in the art), and the one or more (e.g., two, three, four, five, six, seven, eight, nine, or ten) additional target-binding domains (e.g., any of the exemplary target-binding domains described herein or known in the art) bind specifically to different antigens.

In some embodiments of any of the single-chain chimeric polypeptides, one or more of the first target-binding domain, the second target-binding domain, and the one or more target-binding domains is an antigen-binding domain (e.g., any of the exemplary antigen-binding domains described herein or known in the art). In some embodiments of any of the single-chain chimeric polypeptides described herein, the first target-binding domain, the second target-binding domain, and the one or more additional target-binding domains are each an antigen-binding domain (e.g., any of the exemplary antigen-binding domains described herein or known in the art). In some embodiments, the antigen-binding domain can include a scFv or a single domain antibody.

In some embodiments of any of the single-chain chimeric polypeptides described herein, one or more (e.g., two, three, four, five, six, seven, eight, nine, or ten) of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, a receptor for CD122, and a receptor for CD28.

In some embodiments of any of the single-chain chimeric polypeptides described herein, one or more of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is a soluble interleukin or cytokine protein. Non-limiting examples of soluble interleukin proteins and soluble cytokine proteins include: IL-1, IL-2, IL-3, IL-7, IL-8, IL-10, IL-12, IL-15, IL-17, IL-18, IL-21, PDGF-DD, and SCF.

In some embodiments of any of the single-chain chimeric polypeptides described herein, one or more of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is a soluble interleukin or cytokine receptor. Non-limiting examples of soluble interleukin receptors and soluble cytokine receptors include: a soluble TGF-β receptor II (TGF-βRII), a soluble TGF-βRIII, a soluble NKG2D, a soluble NKP30, a soluble NKp44, a soluble NKp46, a soluble DNAM1, a scMHCI, a scMHCII, a scTCR, a soluble CD155, a soluble CD122, a soluble CD3, or a soluble CD28.

In some embodiments of any of the single-chain chimeric polypeptides described herein, the first target-binding domain (e.g., any of the target-binding domains described herein), the second target-binding domain (e.g., any of the target-binding domains described herein), and the one or more additional target-binding domains (e.g., any of the target-binding domains described herein) can each, independently, bind specifically to a target selected from the group of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKP30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

In some embodiments of any of the single-chain chimeric polypeptides described herein, one or more of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is a soluble interleukin or cytokine protein. In some embodiments of any of the multi-chain chimeric polypeptides described herein, the soluble interleukin or cytokine protein is selected from the group of: IL-1, IL-2, IL-3, IL-7, IL-8, IL-10, IL-12, IL-15, IL-17, IL-18, IL-21, PDGF-DD, and SCF.

In some embodiments of any of the single-chain chimeric polypeptides described herein, one or more of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is a soluble interleukin or cytokine receptor. In some embodiments of any of the multi-chain chimeric polypeptides described herein, the soluble receptor is a soluble TGF-β receptor II (TGF-βRII) a soluble TGF-βRIII, a soluble receptor for TNFα, a soluble receptor for IL-4, or a soluble receptor for IL-10.

Multi-Chain Chimeric Polypeptides—Type A

Non-limiting examples of NK cell activating agents are multi-chain chimeric polypeptides that include: (a) a first chimeric polypeptide including: (i) a first target-binding domain; (ii) a soluble tissue factor domain; and (iii) a first domain of a pair of affinity domains; and (b) a second chimeric polypeptide including: (i) a second domain of a pair of affinity domains; and (ii) a second target-binding domain, where the first chimeric polypeptide and the second chimeric polypeptide associate through the binding of the first domain and the second domain of the pair of affinity domains.

In some examples of any of the multi-chain chimeric polypeptides described herein the total length of first chimeric polypeptide and/or the second chimeric polypeptide can each independently be about 50 amino acids to about 3000 amino acids, about 50 amino acids to about 2500 amino acids, about 50 amino acids to about 2000 amino acids, about 50 amino acids to about 1500 amino acids, about 50 amino acids to about 1000 amino acids, about 50 amino acids to about 950 amino acids, about 50 amino acids to about 900 amino acids, about 50 amino acids to about 850 amino acids, about 50 amino acids to about 800 amino acids, about 50 amino acids to about 750 amino acids, about 50 amino acids to about 700 amino acids, about 50 amino acids to about 650 amino acids, about 50 amino acids to about 600 amino acids, about 50 amino acids to about 550 amino acids, about 50 amino acids to about 500 amino acids, about 50 amino acids to about 480 amino acids, about 50 amino acids to about 460 amino acids, about 50 amino acids to about 440 amino acids, about 50 amino acids to about 420 amino acids, about 50 amino acids to about 400 amino acids, about 50 amino acids to about 380 amino acids, about 50 amino acids to about 360 amino acids, about 50 amino acids to about 340 amino acids, about 50 amino acids to about 320 amino acids, about 50 amino acids to about 300 amino acids, about 50 amino acids to about 280 amino acids, about 50 amino acids to about 260 amino acids, about 50 amino acids to about 240 amino acids, about 50 amino acids to about 220 amino acids, about 50 amino acids to about 200 amino acids, about 50 amino acids to about 150 amino acids, about 50 amino acids to about 100 amino acids, about 100 amino acids to about 3000 amino acids, about 100 amino acids to about 2500 amino acids, about 100 amino acids to about 2000 amino acids, about 100 amino acids to about 1500 amino acids, about 100 amino acids to about 1000 amino acids, about 100 amino acids to about 950 amino acids, about 100 amino acids to about 900 amino acids, about 100 amino acids to about 850 amino acids, about 100 amino acids to about 800 amino acids, about 100 amino acids to about 750 amino acids, about 100 amino acids to about 700 amino acids, about 100 amino acids to about 650 amino acids, about 100 amino acids to about 600 amino acids, about 100 amino acids to about 550 amino acids, about 100 amino acids to about 500 amino acids, about 100 amino acids to about 480 amino acids, about 100 amino acids to about 460 amino acids, about 100 amino acids to about 440 amino acids, about 100 amino acids to about 420 amino acids, about 100 amino acids to about 400 amino acids, about 100 amino acids to about 380 amino acids, about 100 amino acids to about 360 amino acids, about 100 amino acids to about 340 amino acids, about 100 amino acids to about 320 amino acids, about 100 amino acids to about 300 amino acids, about 100 amino acids to about 280 amino acids, about 100 amino acids to about 260 amino acids, about 100 amino acids to about 240 amino acids, about 100 amino acids to about 220 amino acids, about 100 amino acids to about 200 amino acids, about 100 amino acids to about 150 amino acids, about 150 amino acids to about 3000 amino acids, about 150 amino acids to about 2500 amino acids, about 150 amino acids to about 2000 amino acids, about 150 amino acids to about 1500 amino acids, about 150 amino acids to about 1000 amino acids, about 150 amino acids to about 950 amino acids, about 150 amino acids to about 900 amino acids, about 150 amino acids to about 850 amino acids, about 150 amino acids to about 800 amino acids, about 150 amino acids to about 750 amino acids, about 150 amino acids to about 700 amino acids, about 150 amino acids to about 650 amino acids, about 150 amino acids to about 600 amino acids, about 150 amino acids to about 550 amino acids, about 150 amino acids to about 500 amino acids, about 150 amino acids to about 480 amino acids, about 150 amino acids to about 460 amino acids, about 150 amino acids to about 440 amino acids, about 150 amino acids to about 420 amino acids, about 150 amino acids to about 400 amino acids, about 150 amino acids to about 380 amino acids, about 150 amino acids to about 360 amino acids, about 150 amino acids to about 340 amino acids, about 150 amino acids to about 320 amino acids, about 150 amino acids to about 300 amino acids, about 150 amino acids to about 280 amino acids, about 150 amino acids to about 260 amino acids, about 150 amino acids to about 240 amino acids, about 150 amino acids to about 220 amino acids, about 150 amino acids to about 200 amino acids, about 200 amino acids to about 3000 amino acids, about 200 amino acids to about 2500 amino acids, about 200 amino acids to about 2000 amino acids, about 200 amino acids to about 1500 amino acids, about 200 amino acids to about 1000 amino acids, about 200 amino acids to about 950 amino acids, about 200 amino acids to about 900 amino acids, about 200 amino acids to about 850 amino acids, about 200 amino acids to about 800 amino acids, about 200 amino acids to about 750 amino acids, about 200 amino acids to about 700 amino acids, about 200 amino acids to about 650 amino acids, about 200 amino acids to about 600 amino acids, about 200 amino acids to about 550 amino acids, about 200 amino acids to about 500 amino acids, about 200 amino acids to about 480 amino acids, about 200 amino acids to about 460 amino acids, about 200 amino acids to about 440 amino acids, about 200 amino acids to about 420 amino acids, about 200 amino acids to about 400 amino acids, about 200 amino acids to about 380 amino acids, about 200 amino acids to about 360 amino acids, about 200 amino acids to about 340 amino acids, about 200 amino acids to about 320 amino acids, about 200 amino acids to about 300 amino acids, about 200 amino acids to about 280 amino acids, about 200 amino acids to about 260 amino acids, about 200 amino acids to about 240 amino acids, about 200 amino acids to about 220 amino acids, about 220 amino acids to about 3000 amino acids, about 220 amino acids to about 2500 amino acids, about 220 amino acids to about 2000 amino acids, about 220 amino acids to about 1500 amino acids, about 220 amino acids to about 1000 amino acids, about 220 amino acids to about 950 amino acids, about 220 amino acids to about 900 amino acids, about 220 amino acids to about 850 amino acids, about 220 amino acids to about 800 amino acids, about 220 amino acids to about 750 amino acids, about 220 amino acids to about 700 amino acids, about 220 amino acids to about 650 amino acids, about 220 amino acids to about 600 amino acids, about 220 amino acids to about 550 amino acids, about 220 amino acids to about 500 amino acids, about 220 amino acids to about 480 amino acids, about 220 amino acids to about 460 amino acids, about 220 amino acids to about 440 amino acids, about 220 amino acids to about 420 amino acids, about 220 amino acids to about 400 amino acids, about 220 amino acids to about 380 amino acids, about 220 amino acids to about 360 amino acids, about 220 amino acids to about 340 amino acids, about 220 amino acids to about 320 amino acids, about 220 amino acids to about 300 amino acids, about 220 amino acids to about 280 amino acids, about 220 amino acids to about 260 amino acids, about 220 amino acids to about 240 amino acids, about 240 amino acids to about 3000 amino acids, about 240 amino acids to about 2500 amino acids, about 240 amino acids to about 2000 amino acids, about 240 amino acids to about 1500 amino acids, about 240 amino acids to about 1000 amino acids, about 240 amino acids to about 950 amino acids, about 240 amino acids to about 900 amino acids, about 240 amino acids to about 850 amino acids, about 240 amino acids to about 800 amino acids, about 240 amino acids to about 750 amino acids, about 240 amino acids to about 700 amino acids, about 240 amino acids to about 650 amino acids, about 240 amino acids to about 600 amino acids, about 240 amino acids to about 550 amino acids, about 240 amino acids to about 500 amino acids, about 240 amino acids to about 480 amino acids, about 240 amino acids to about 460 amino acids, about 240 amino acids to about 440 amino acids, about 240 amino acids to about 420 amino acids, about 240 amino acids to about 400 amino acids, about 240 amino acids to about 380 amino acids, about 240 amino acids to about 360 amino acids, about 240 amino acids to about 340 amino acids, about 240 amino acids to about 320 amino acids, about 240 amino acids to about 300 amino acids, about 240 amino acids to about 280 amino acids, about 240 amino acids to about 260 amino acids, about 260 amino acids to about 3000 amino acids, about 260 amino acids to about 2500 amino acids, about 260 amino acids to about 2000 amino acids, about 260 amino acids to about 1500 amino acids, about 260 amino acids to about 1000 amino acids, about 260 amino acids to about 950 amino acids, about 260 amino acids to about 900 amino acids, about 260 amino acids to about 850 amino acids, about 260 amino acids to about 800 amino acids, about 260 amino acids to about 750 amino acids, about 260 amino acids to about 700 amino acids, about 260 amino acids to about 650 amino acids, about 260 amino acids to about 600 amino acids, about 260 amino acids to about 550 amino acids, about 260 amino acids to about 500 amino acids, about 260 amino acids to about 480 amino acids, about 260 amino acids to about 460 amino acids, about 260 amino acids to about 440 amino acids, about 260 amino acids to about 420 amino acids, about 260 amino acids to about 400 amino acids, about 260 amino acids to about 380 amino acids, about 260 amino acids to about 360 amino acids, about 260 amino acids to about 340 amino acids, about 260 amino acids to about 320 amino acids, about 260 amino acids to about 300 amino acids, about 260 amino acids to about 280 amino acids, about 280 amino acids to about 3000 amino acids, about 280 amino acids to about 2500 amino acids, about 280 amino acids to about 2000 amino acids, about 280 amino acids to about 1500 amino acids, about 280 amino acids to about 1000 amino acids, about 280 amino acids to about 950 amino acids, about 280 amino acids to about 900 amino acids, about 280 amino acids to about 850 amino acids, about 280 amino acids to about 800 amino acids, about 280 amino acids to about 750 amino acids, about 280 amino acids to about 700 amino acids, about 280 amino acids to about 650 amino acids, about 280 amino acids to about 600 amino acids, about 280 amino acids to about 550 amino acids, about 280 amino acids to about 500 amino acids, about 280 amino acids to about 480 amino acids, about 280 amino acids to about 460 amino acids, about 280 amino acids to about 440 amino acids, about 280 amino acids to about 420 amino acids, about 280 amino acids to about 400 amino acids, about 280 amino acids to about 380 amino acids, about 280 amino acids to about 360 amino acids, about 280 amino acids to about 340 amino acids, about 280 amino acids to about 320 amino acids, about 280 amino acids to about 300 amino acids, about 300 amino acids to about 3000 amino acids, about 300 amino acids to about 2500 amino acids, about 300 amino acids to about 2000 amino acids, about 300 amino acids to about 1500 amino acids, about 300 amino acids to about 1000 amino acids, about 300 amino acids to about 950 amino acids, about 300 amino acids to about 900 amino acids, about 300 amino acids to about 850 amino acids, about 300 amino acids to about 800 amino acids, about 300 amino acids to about 750 amino acids, about 300 amino acids to about 700 amino acids, about 300 amino acids to about 650 amino acids, about 300 amino acids to about 600 amino acids, about 300 amino acids to about 550 amino acids, about 300 amino acids to about 500 amino acids, about 300 amino acids to about 480 amino acids, about 300 amino acids to about 460 amino acids, about 300 amino acids to about 440 amino acids, about 300 amino acids to about 420 amino acids, about 300 amino acids to about 400 amino acids, about 300 amino acids to about 380 amino acids, about 300 amino acids to about 360 amino acids, about 300 amino acids to about 340 amino acids, about 300 amino acids to about 320 amino acids, about 320 amino acids to about 3000 amino acids, about 320 amino acids to about 2500 amino acids, about 320 amino acids to about 2000 amino acids, about 320 amino acids to about 1500 amino acids, about 320 amino acids to about 1000 amino acids, about 320 amino acids to about 950 amino acids, about 320 amino acids to about 900 amino acids, about 320 amino acids to about 850 amino acids, about 320 amino acids to about 800 amino acids, about 320 amino acids to about 750 amino acids, about 320 amino acids to about 700 amino acids, about 320 amino acids to about 650 amino acids, about 320 amino acids to about 600 amino acids, about 320 amino acids to about 550 amino acids, about 320 amino acids to about 500 amino acids, about 320 amino acids to about 480 amino acids, about 320 amino acids to about 460 amino acids, about 320 amino acids to about 440 amino acids, about 320 amino acids to about 420 amino acids, about 320 amino acids to about 400 amino acids, about 320 amino acids to about 380 amino acids, about 320 amino acids to about 360 amino acids, about 320 amino acids to about 340 amino acids, about 340 amino acids to about 3000 amino acids, about 340 amino acids to about 2500 amino acids, about 340 amino acids to about 2000 amino acids, about 340 amino acids to about 1500 amino acids, about 340 amino acids to about 1000 amino acids, about 340 amino acids to about 950 amino acids, about 340 amino acids to about 900 amino acids, about 340 amino acids to about 850 amino acids, about 340 amino acids to about 800 amino acids, about 340 amino acids to about 750 amino acids, about 340 amino acids to about 700 amino acids, about 340 amino acids to about 650 amino acids, about 340 amino acids to about 600 amino acids, about 340 amino acids to about 550 amino acids, about 340 amino acids to about 500 amino acids, about 340 amino acids to about 480 amino acids, about 340 amino acids to about 460 amino acids, about 340 amino acids to about 440 amino acids, about 340 amino acids to about 420 amino acids, about 340 amino acids to about 400 amino acids, about 340 amino acids to about 380 amino acids, about 340 amino acids to about 360 amino acids, about 360 amino acids to about 3000 amino acids, about 360 amino acids to about 2500 amino acids, about 360 amino acids to about 2000 amino acids, about 360 amino acids to about 1500 amino acids, about 360 amino acids to about 1000 amino acids, about 360 amino acids to about 950 amino acids, about 360 amino acids to about 900 amino acids, about 360 amino acids to about 850 amino acids, about 360 amino acids to about 800 amino acids, about 360 amino acids to about 750 amino acids, about 360 amino acids to about 700 amino acids, about 360 amino acids to about 650 amino acids, about 360 amino acids to about 600 amino acids, about 360 amino acids to about 550 amino acids, about 360 amino acids to about 500 amino acids, about 360 amino acids to about 480 amino acids, about 360 amino acids to about 460 amino acids, about 360 amino acids to about 440 amino acids, about 360 amino acids to about 420 amino acids, about 360 amino acids to about 400 amino acids, about 360 amino acids to about 380 amino acids, about 380 amino acids to about 3000 amino acids, about 380 amino acids to about 2500 amino acids, about 380 amino acids to about 2000 amino acids, about 380 amino acids to about 1500 amino acids, about 380 amino acids to about 1000 amino acids, about 380 amino acids to about 950 amino acids, about 380 amino acids to about 900 amino acids, about 380 amino acids to about 850 amino acids, about 380 amino acids to about 800 amino acids, about 380 amino acids to about 750 amino acids, about 380 amino acids to about 700 amino acids, about 380 amino acids to about 650 amino acids, about 380 amino acids to about 600 amino acids, about 380 amino acids to about 550 amino acids, about 380 amino acids to about 500 amino acids, about 380 amino acids to about 480 amino acids, about 380 amino acids to about 460 amino acids, about 380 amino acids to about 440 amino acids, about 380 amino acids to about 420 amino acids, about 380 amino acids to about 400 amino acids, about 400 amino acids to about 3000 amino acids, about 400 amino acids to about 2500 amino acids, about 400 amino acids to about 2000 amino acids, about 400 amino acids to about 1500 amino acids, about 400 amino acids to about 1000 amino acids, about 400 amino acids to about 950 amino acids, about 400 amino acids to about 900 amino acids, about 400 amino acids to about 850 amino acids, about 400 amino acids to about 800 amino acids, about 400 amino acids to about 750 amino acids, about 400 amino acids to about 700 amino acids, about 400 amino acids to about 650 amino acids, about 400 amino acids to about 600 amino acids, about 400 amino acids to about 550 amino acids, about 400 amino acids to about 500 amino acids, about 400 amino acids to about 480 amino acids, about 400 amino acids to about 460 amino acids, about 400 amino acids to about 440 amino acids, about 400 amino acids to about 420 amino acids, about 420 amino acids to about 3000 amino acids, about 420 amino acids to about 2500 amino acids, about 420 amino acids to about 2000 amino acids, about 420 amino acids to about 1500 amino acids, about 420 amino acids to about 1000 amino acids, about 420 amino acids to about 950 amino acids, about 420 amino acids to about 900 amino acids, about 420 amino acids to about 850 amino acids, about 420 amino acids to about 800 amino acids, about 420 amino acids to about 750 amino acids, about 420 amino acids to about 700 amino acids, about 420 amino acids to about 650 amino acids, about 420 amino acids to about 600 amino acids, about 420 amino acids to about 550 amino acids, about 420 amino acids to about 500 amino acids, about 420 amino acids to about 480 amino acids, about 420 amino acids to about 460 amino acids, about 420 amino acids to about 440 amino acids, about 440 amino acids to about 3000 amino acids, about 440 amino acids to about 2500 amino acids, about 440 amino acids to about 2000 amino acids, about 440 amino acids to about 1500 amino acids, about 440 amino acids to about 1000 amino acids, about 440 amino acids to about 950 amino acids, about 440 amino acids to about 900 amino acids, about 440 amino acids to about 850 amino acids, about 440 amino acids to about 800 amino acids, about 440 amino acids to about 750 amino acids, about 440 amino acids to about 700 amino acids, about 440 amino acids to about 650 amino acids, about 440 amino acids to about 600 amino acids, about 440 amino acids to about 550 amino acids, about 440 amino acids to about 500 amino acids, about 440 amino acids to about 480 amino acids, about 440 amino acids to about 460 amino acids, about 460 amino acids to about 3000 amino acids, about 460 amino acids to about 2500 amino acids, about 460 amino acids to about 2000 amino acids, about 460 amino acids to about 1500 amino acids, about 460 amino acids to about 1000 amino acids, about 460 amino acids to about 950 amino acids, about 460 amino acids to about 900 amino acids, about 460 amino acids to about 850 amino acids, about 460 amino acids to about 800 amino acids, about 460 amino acids to about 750 amino acids, about 460 amino acids to about 700 amino acids, about 460 amino acids to about 650 amino acids, about 460 amino acids to about 600 amino acids, about 460 amino acids to about 550 amino acids, about 460 amino acids to about 500 amino acids, about 460 amino acids to about 480 amino acids, about 480 amino acids to about 3000 amino acids, about 480 amino acids to about 2500 amino acids, about 480 amino acids to about 2000 amino acids, about 480 amino acids to about 1500 amino acids, about 480 amino acids to about 1000 amino acids, about 480 amino acids to about 950 amino acids, about 480 amino acids to about 900 amino acids, about 480 amino acids to about 850 amino acids, about 480 amino acids to about 800 amino acids, about 480 amino acids to about 750 amino acids, about 480 amino acids to about 700 amino acids, about 480 amino acids to about 650 amino acids, about 480 amino acids to about 600 amino acids, about 480 amino acids to about 550 amino acids, about 480 amino acids to about 500 amino acids, about 500 amino acids to about 3000 amino acids, about 500 amino acids to about 2500 amino acids, about 500 amino acids to about 2000 amino acids, about 500 amino acids to about 1500 amino acids, about 500 amino acids to about 1000 amino acids, about 500 amino acids to about 950 amino acids, about 500 amino acids to about 900 amino acids, about 500 amino acids to about 850 amino acids, about 500 amino acids to about 800 amino acids, about 500 amino acids to about 750 amino acids, about 500 amino acids to about 700 amino acids, about 500 amino acids to about 650 amino acids, about 500 amino acids to about 600 amino acids, about 500 amino acids to about 550 amino acids, about 550 amino acids to about 3000 amino acids, about 550 amino acids to about 2500 amino acids, about 550 amino acids to about 2000 amino acids, about 550 amino acids to about 1500 amino acids, about 550 amino acids to about 1000 amino acids, about 550 amino acids to about 950 amino acids, about 550 amino acids to about 900 amino acids, about 550 amino acids to about 850 amino acids, about 550 amino acids to about 800 amino acids, about 550 amino acids to about 750 amino acids, about 550 amino acids to about 700 amino acids, about 550 amino acids to about 650 amino acids, about 550 amino acids to about 600 amino acids, about 600 amino acids to about 3000 amino acids, about 600 amino acids to about 2500 amino acids, about 600 amino acids to about 2000 amino acids, about 600 amino acids to about 1500 amino acids, about 600 amino acids to about 1000 amino acids, about 600 amino acids to about 950 amino acids, about 600 amino acids to about 900 amino acids, about 600 amino acids to about 850 amino acids, about 600 amino acids to about 800 amino acids, about 600 amino acids to about 750 amino acids, about 600 amino acids to about 700 amino acids, about 600 amino acids to about 650 amino acids, about 650 amino acids to about 3000 amino acids, about 650 amino acids to about 2500 amino acids, about 650 amino acids to about 2000 amino acids, about 650 amino acids to about 1500 amino acids, about 650 amino acids to about 1000 amino acids, about 650 amino acids to about 950 amino acids, about 650 amino acids to about 900 amino acids, about 650 amino acids to about 850 amino acids, about 650 amino acids to about 800 amino acids, about 650 amino acids to about 750 amino acids, about 650 amino acids to about 700 amino acids, about 700 amino acids to about 3000 amino acids, about 700 amino acids to about 2500 amino acids, about 700 amino acids to about 2000 amino acids, about 700 amino acids to about 1500 amino acids, about 700 amino acids to about 1000 amino acids, about 700 amino acids to about 950 amino acids, about 700 amino acids to about 900 amino acids, about 700 amino acids to about 850 amino acids, about 700 amino acids to about 800 amino acids, about 700 amino acids to about 750 amino acids, about 750 amino acids to about 3000 amino acids, about 750 amino acids to about 2500 amino acids, about 750 amino acids to about 2000 amino acids, about 750 amino acids to about 1500 amino acids, about 750 amino acids to about 1000 amino acids, about 750 amino acids to about 950 amino acids, about 750 amino acids to about 900 amino acids, about 750 amino acids to about 850 amino acids, about 750 amino acids to about 800 amino acids, about 800 amino acids to about 3000 amino acids, about 800 amino acids to about 2500 amino acids, about 800 amino acids to about 2000 amino acids, about 800 amino acids to about 1500 amino acids, about 800 amino acids to about 1000 amino acids, about 800 amino acids to about 950 amino acids, about 800 amino acids to about 900 amino acids, about 800 amino acids to about 850 amino acids, about 850 amino acids to about 3000 amino acids, about 850 amino acids to about 2500 amino acids, about 850 amino acids to about 2000 amino acids, about 850 amino acids to about 1500 amino acids, about 850 amino acids to about 1000 amino acids, about 850 amino acids to about 950 amino acids, about 850 amino acids to about 900 amino acids, about 900 amino acids to about 3000 amino acids, about 900 amino acids to about 2500 amino acids, about 900 amino acids to about 2000 amino acids, about 900 amino acids to about 1500 amino acids, about 900 amino acids to about 1000 amino acids, about 900 amino acids to about 950 amino acids, about 950 amino acids to about 3000 amino acids, about 950 amino acids to about 2500 amino acids, about 950 amino acids to about 2000 amino acids, about 950 amino acids to about 1500 amino acids, about 950 amino acids to about 1000 amino acids, about 1000 amino acids to about 3000 amino acids, about 1000 amino acids to about 2500 amino acids, about 1000 amino acids to about 2000 amino acids, about 1000 amino acids to about 1500 amino acids, about 1500 amino acids to about 3000 amino acids, about 1500 amino acids to about 2500 amino acids, about 1500 amino acids to about 2000 amino acids, about 2000 amino acids to about 3000 amino acids, about 2000 amino acids to about 2500 amino acids, or about 2500 amino acids to about 3000 amino acids.

In some embodiments of any of the multi-chain chimeric polypeptides described herein, the first target-binding domain (e.g., any of the first target-binding domains described herein) and the soluble tissue factor domain (e.g., any of the exemplary soluble tissue factor domains described herein) directly abut each other in the first chimeric polypeptide. In some embodiments of any of the multi-chain chimeric polypeptides described herein, the first chimeric polypeptide further comprises a linker sequence (e.g., any of the exemplary linker sequences described herein or known in the art) between the first target-binding domain (e.g., any of the exemplary first target-binding domains described herein) and the soluble tissue factor domain (e.g., any of the exemplary soluble tissue factor domains described herein) in the first chimeric polypeptide.

In some embodiments of any of the multi-chain chimeric polypeptides described herein, the soluble tissue factor domain (e.g., any of the exemplary soluble tissue factor domains described herein) and the first domain of the pair of affinity domains (e.g., any of the exemplary first domains of any of the exemplary pairs of affinity domains described herein) directly abut each other in the first chimeric polypeptide. In some embodiments of any of the multi-chain chimeric polypeptides described herein, the first chimeric polypeptide further comprises a linker sequence (e.g., any of the exemplary linker sequences described herein or known in the art) between the soluble tissue factor domain (e.g., any of the exemplary soluble tissue factor domains described herein) and the first domain of the pair of affinity domains (e.g., any of the exemplary first domains of any of the exemplary pairs of affinity domains described herein) in the first chimeric polypeptide.

In some embodiments of any of the multi-chain chimeric polypeptides described herein, the second domain of the pair of affinity domains (e.g., any of the exemplary second domains of any of the exemplary pairs of affinity domains described herein) and the second target-binding domain (e.g., any of the exemplary second target-binding domains described herein) directly abut each other in the second chimeric polypeptide. In some embodiments of any of the multi-chain chimeric polypeptides described herein, the second chimeric polypeptide further comprises a linker sequence (e.g., any of the exemplary linker sequences described herein or known in the art) between the second domain of the pair of affinity domains (e.g., any of the exemplary second domains of any of the exemplary pairs of affinity domains described herein) and the second target-binding domain (e.g., any of the exemplary second target-binding domains described herein) in the second chimeric polypeptide.

In some embodiments of any of the multi-chain chimeric polypeptides, the first chimeric polypeptide further includes one or more (e.g., two, three, four, five, six, seven, eight, nine, or ten) additional target-binding domain(s) (e.g., any of the exemplary target-binding domains described herein or known in the art), where at least one of the one or more additional antigen-binding domain(s) is positioned between the soluble tissue factor domain (e.g., any of the exemplary soluble tissue factor domains described herein or known in the art) and the first domain of the pair of affinity domains (e.g., any of the exemplary first domains of any of the exemplary pairs of affinity domains described herein). In some embodiments, the first chimeric polypeptide can further include a linker sequence (e.g., any of the exemplary linker sequences described herein or known in the art) between the soluble tissue factor domain (e.g., any of the exemplary soluble tissue factor domains described herein) and the at least one of the one or more additional target-binding domain(s) (e.g., any of the exemplary target-binding domains described herein or known in the art), and/or a linker sequence (e.g., any of the exemplary linker sequences described herein or known in the art) between the at least one of the one or more additional target-binding domain(s) (e.g., any of the exemplary target-binding domains described herein or known in the art) and the first domain of the pair of affinity domains (e.g., any of the exemplary first domains described herein of any of the exemplary pairs of affinity domains described herein).

In some embodiments of any of the multi-chain chimeric polypeptides described herein, the first chimeric polypeptide further includes one or more (e.g., two, three, four, five, six, seven, eight, nine, or ten) additional target-binding domains at the N-terminal and/or C-terminal end of the first chimeric polypeptide. In some embodiments, at least one of the one or more additional target-binding domains (e.g., any of the exemplary target-binding domains described herein or known in the art) directly abuts the first domain of the pair of affinity domains (e.g., any of the exemplary first domains described herein of any of the exemplary pairs of affinity domains described herein) in the first chimeric polypeptide. In some embodiments, the first chimeric polypeptide further includes a linker sequence (e.g., any of the exemplary linker sequences described herein or known in the art) between the at least one of the one or more additional target-binding domains (e.g., any of the exemplary target-binding domains described herein or known in the art) and the first domain of the pair of affinity domains (e.g., any of the exemplary first domains described herein of any of the exemplary pairs of affinity domains described herein). In some embodiments, the at least one of the one or more additional target-binding domains (e.g., any of the exemplary target-binding domains described herein or known in the art) directly abuts the first target-binding domain (e.g., any of the exemplary target-binding domains described herein or known in the art) in the first chimeric polypeptide. In some embodiments, the first chimeric polypeptide further comprises a linker sequence (e.g., any of the exemplary linker sequences described herein or known in the art) between the at least one of the one or more additional target-binding domains (e.g., any of the exemplary target-binding domains described herein or known in the art) and the first target-binding domain (e.g., any of the exemplary target-binding domains described herein or known in the art).

In some embodiments of any of the multi-chain chimeric polypeptides described herein, at least one of the one or more additional target-binding domains (e.g., any of the exemplary target-binding domains described herein or known in the art) is disposed at the N- and/or C-terminus of the first chimeric polypeptide, and at least one of the one or more additional target-binding domains (e.g., any of the exemplary target-binding domains described herein or known in the art) is positioned between the soluble tissue factor domain (e.g., any of the exemplary soluble tissue factor domains described herein or known in the art) and the first domain of the pair of affinity domains (e.g., any of the exemplary first domains of any of the exemplary pairs of affinity domains described herein) in the first chimeric polypeptide. In some embodiments, the at least one additional target-binding domain (e.g., any of the exemplary target-binding domains described herein or known in the art) of the one or more additional target-binding domains disposed at the N-terminus directly abuts the first target-binding domain (e.g., any of the exemplary target-binding domains described herein or known in the art) or the first domain of the pair of affinity domains (e.g., any of the exemplary first domains described herein of any of the exemplary pairs of affinity domains described herein) in the first chimeric polypeptide. In some embodiments, the first chimeric polypeptide further comprises a linker sequence (e.g., any of the linker sequences described herein or known in the art) disposed between the at least one additional target-binding domain (e.g., any of the exemplary target-binding domains described herein or known in the art) and the first target-binding domain (e.g., any of the exemplary target-binding domains described herein or known in the art) or the first domain of the pair of affinity domains (e.g., any of the exemplary first domains described herein of any of the exemplary pairs of affinity domains described herein) in the first chimeric polypeptide. In some embodiments, the at least one additional target-binding domain (e.g., any of the exemplary target-binding domains described herein or known in the art) of the one or more additional target-binding domains disposed at the C-terminus directly abuts the first target-binding domain (e.g., any of the exemplary target-binding domains described herein or known in the art) or the first domain of the pair of affinity domains (e.g., any of the exemplary first domains of any of the exemplary pairs of affinity domains described herein) in the first chimeric polypeptide. In some embodiments, the first chimeric polypeptide further includes a linker sequence (e.g., any of the exemplary linker sequences described herein or known in the art) disposed between the at least one additional target-binding domain (e.g., any of the exemplary target-binding domains described herein or known in the art) and the first target-binding domain (e.g., any of the exemplary target-binding domains described herein or known in the art) or the first domain of the pair of affinity domains (e.g., any of the exemplary first domains described herein of any of the exemplary pairs of affinity domains described herein) in the first chimeric polypeptide. In some embodiments, the at least one of the one or more additional target-binding domains (e.g., any of the exemplary target-binding domains described herein or known in the art) positioned between the soluble tissue factor domain (e.g., any of the exemplary soluble tissue factor domains described herein) and the first domain of the pair of affinity domains (e.g., any of the first domains described herein or any of the exemplary pairs of affinity domains described herein), directly abuts the soluble tissue factor domain and/or the first domain of the pair of affinity domains. In some embodiments, the first chimeric polypeptide further comprises a linker sequence (e.g., any of the exemplary linker sequences described herein or known in the art) disposed (i) between the soluble tissue factor domain (e.g., any of the exemplary soluble tissue factor domains described herein) and the at least one of the one or more additional target-binding domains (e.g., any of the exemplary target-binding domains described herein or known in the art) positioned between the soluble tissue factor domain (e.g., any of the exemplary soluble tissue factor domains described herein) and the first domain of the pair of affinity domains (e.g., any of the exemplary first domains of any of the exemplary pairs of affinity domains described herein), and/or (ii) between the first domain of the pair of affinity domains and the at least one of the one or more additional target-binding domains positioned between the soluble tissue factor domain and the first domain of the pair of affinity domains.

In some embodiments of any of the multi-chain chimeric polypeptides described herein, the second chimeric polypeptide further includes one or more (e.g., two, three, four, five, six, seven, eight, nine, or ten) additional target-binding domains (e.g., any of the exemplary target-binding domains described herein or known in the art) at the N-terminal end and/or the C-terminal end of the second chimeric polypeptide. In some embodiments, at least one of the one or more additional target-binding domains (e.g., any of the exemplary target-binding domains described herein or known in the art) directly abuts the second domain of the pair of affinity domains (e.g., any of the exemplary second domains of any of the exemplary pairs of affinity domains described herein) in the second chimeric polypeptide. In some embodiments, the second chimeric polypeptide further includes a linker sequence (e.g., any of the exemplary linker sequences described herein or known in the art) between at least one of the one or more additional target-binding domains (e.g., any of the exemplary target-binding domains described herein or known in the art) and the second domain of the pair of affinity domains (e.g., any of the second domains described herein of any of the exemplary pairs of affinity domains described herein) in the second chimeric polypeptide. In some embodiments, at least one of the one or more additional target-binding domains (e.g., any of the exemplary target-binding domains described herein or known in the art) directly abuts the second target-binding domain (e.g., any of the target-binding domains described herein or known in the art) in the second chimeric polypeptide. In some embodiments, the second chimeric polypeptide further includes a linker sequence (e.g., any of the exemplary linker sequences described herein or known in the art) between at least one of the one or more additional target-binding domains (e.g., any of the exemplary target binding domains described herein or known in the art) and the second target-binding domain (e.g., any of the exemplary target binding domains described herein or known in the art) in the second chimeric polypeptide.

In some embodiments of any of the multi-chain chimeric polypeptides described herein, two or more (e.g., three or more, four or more, five or more, six or more, seven or more, eight or more, nine or more, or ten or more) of the first target-binding domain, the second target-binding domain, and the one or more additional target-binding domains bind specifically to the same antigen. In some embodiments, two or more (e.g., three or more, four or more, five or more, six or more, seven or more, eight or more, nine or more, or ten or more) of the first target-binding domain, the second target-binding domain, and the one or more additional target-binding domains bind specifically to the same epitope. In some embodiments, two or more (e.g., three or more, four or more, five or more, six or more, seven or more, eight or more, nine or more, or ten or more) of the first target-binding domain, the second target-binding domain, and the one or more additional target-binding domains include the same amino acid sequence. In some embodiments, the first target-binding domain, the second target-binding domain, and the one or more additional target-binding domains each bind specifically to the same antigen. In some embodiments, the first target-binding domain, the second target-binding domain, and the one or more additional target-binding domains each bind specifically to the same epitope. In some embodiments, the first target-binding domain, the second target-binding domain, and the one or more additional target-binding domains each include the same amino acid sequence.

In some embodiments of any of the multi-chain chimeric polypeptides described herein, the first target-binding domain, the second target-binding domain, and the one or more additional target-binding domains bind specifically to different antigens. In some embodiments of any of the multi-chain chimeric polypeptides described herein, one or more (e.g., two or more, three or more, four or more, five or more, six or more, seven or more, eight or more, nine or more, or ten or more) of the first target-binding domain, the second target-binding domain, and the one or more additional target-binding domains is an antigen-binding domain. In some embodiments, the first target-binding domain, the second target-binding domain, and the one or more additional target-binding domains are each an antigen-binding domain (e.g., a scFv or a single-domain antibody).

In some embodiments of any of the multi-chain chimeric polypeptides described herein, one or more (e.g., two, three, four, five, six, seven, eight, nine, or ten) of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKP30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, a receptor for CD122, and a receptor for CD28.

In some embodiments of any of the multi-chain chimeric polypeptides described herein, one or more of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is a soluble interleukin or cytokine protein. Non-limiting examples of soluble interleukin proteins and soluble cytokine proteins include: IL-1, IL-2, IL-3, IL-7, IL-8, IL-10, IL-12, IL-15, IL-17, IL-18, IL-21, PDGF-DD, and SCF.

In some embodiments of any of the multi-chain chimeric polypeptides described herein, one or more of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is a soluble interleukin or cytokine receptor. Non-limiting examples of soluble interleukin receptors and soluble cytokine receptors include: a soluble TGF-β receptor II (TGF-βRII), a soluble TGF-βRIII, a soluble NKG2D, a soluble NKP30, a soluble NKp44, a soluble NKp46, a soluble DNAM1, a scMHCI, a scMHCII, a scTCR, a soluble CD155, a soluble CD122, a soluble CD3, or a soluble CD28.

In some embodiments of any of the multi-chain chimeric polypeptides described herein, the first target-binding domain (e.g., any of the target-binding domains described herein, the second target-binding domain (e.g., any of the target-binding domains described herein), and the one or more additional target-binding domains (e.g., any of the target-binding domains described herein) can each, independently, bind specifically to a target selected from the group of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

In some embodiments of any of the multi-chain chimeric polypeptides described herein, one or both of the first target-binding domain (e.g., any of the target-binding domains described herein), the second target-binding domain (e.g., any of the target-binding domains described herein), and the one or more additional binding domains (e.g., any of the target-binding described herein) is a soluble interleukin or cytokine protein. In some embodiments of any of the multi-chain chimeric polypeptides described herein, the soluble interleukin or cytokine protein is selected from the group of: IL-1, IL-2, IL-3, IL-7, IL-8, IL-10, IL-12, IL-15, IL-17, IL-18, IL-21, PDGF-DD, and SCF.

In some embodiments of any of the multi-chain chimeric polypeptides described herein, one or both of the first target-binding domain and the second target-binding domain is a soluble interleukin or cytokine receptor. In some embodiments of any of the multi-chain chimeric polypeptides described herein, the soluble receptor is a soluble TGF-β receptor II (TGF-βRII) a soluble TGF-βRIII, a soluble receptor for TNFα, a soluble receptor for IL-4, or a soluble receptor for IL-10.

Multi-Chain Chimeric Polypeptides—Type B

Non-limiting examples of NK cell activating agents are multi-chain chimeric polypeptides that include: (a) a first and second chimeric polypeptide each including: (i) a first target-binding domain; (ii) a Fc domain; and (iii) a first domain of a pair of affinity domains; and (b) a third and fourth chimeric polypeptide each including: (i) a second domain of a pair of affinity domains; and (ii) a second target-binding domain, where the first and second chimeric polypeptides and the third and fourth chimeric polypeptides associate through the binding of the first domain and the second domain of the pair of affinity domains, and the first and second chimeric polypeptides associate through their Fc domains.

In some embodiments of any of the multi-chain chimeric polypeptides described herein, the first target-binding domain (e.g., any of the first target-binding domains described herein) and the Fc domain (e.g., any of the exemplary Fc domains described herein) directly abut each other in the first and second chimeric polypeptides. In some embodiments of any of the multi-chain chimeric polypeptides described herein, the first and second chimeric polypeptides further comprise a linker sequence (e.g., any of the exemplary linker sequences described herein or known in the art) between the first target-binding domain (e.g., any of the exemplary first target-binding domains described herein) and the Fc domain (e.g., any of the exemplary Fc domains described herein) in the first and second chimeric polypeptides.

In some embodiments of any of the multi-chain chimeric polypeptides described herein, the Fc domain (e.g., any of the exemplary Fc domains described herein) and the first domain of the pair of affinity domains (e.g., any of the exemplary first domains of any of the exemplary pairs of affinity domains described herein) directly abut each other in the first and second chimeric polypeptide. In some embodiments of any of the multi-chain chimeric polypeptides described herein, the first and second chimeric polypeptide further comprises a linker sequence (e.g., any of the exemplary linker sequences described herein or known in the art) between the Fc domain (e.g., any of the exemplary Fc domains described herein) and the first domain of the pair of affinity domains (e.g., any of the exemplary first domains of any of the exemplary pairs of affinity domains described herein) in the first and second chimeric polypeptide.

In some embodiments of any of the multi-chain chimeric polypeptides described herein, the second domain of the pair of affinity domains (e.g., any of the exemplary second domains of any of the exemplary pairs of affinity domains described herein) and the second target-binding domain (e.g., any of the exemplary second target-binding domains described herein) directly abut each other in the third and fourth chimeric polypeptide. In some embodiments of any of the multi-chain chimeric polypeptides described herein, the third and fourth chimeric polypeptide further comprise a linker sequence (e.g., any of the exemplary linker sequences described herein or known in the art) between the second domain of the pair of affinity domains (e.g., any of the exemplary second domains of any of the exemplary pairs of affinity domains described herein) and the second target-binding domain (e.g., any of the exemplary second target-binding domains described herein) in the third and fourth chimeric polypeptide.

In some embodiments of any of the multi-chain chimeric polypeptides described herein, the first target-binding domain and the second target-binding domain bind specifically to the same antigen. In some embodiments of any of the multi-chain chimeric polypeptides described herein, the first target-binding domain and the second target-binding domain bind specifically to the same epitope. In some embodiments of any of the multi-chain chimeric polypeptides described herein, the first target-binding domain and the second target-binding domain include the same amino acid sequence. In some embodiments of any of the multi-chain chimeric polypeptides described herein, the first target-binding domain and the second target-binding domain bind specifically to different antigens. In some embodiments of any of the multi-chain chimeric polypeptides described herein, one or both of the first target-binding domain and the second target-binding domain is an antigen-binding domain (e.g., any of the exemplary second target-binding domains described herein). In some embodiments of any of the multi-chain chimeric polypeptides described herein, the first target-binding domain and the second target-binding domain are each antigen-binding domains (e.g., any of the exemplary second target-binding domains described herein). In some embodiments of any of the multi-chain chimeric polypeptides described herein, the antigen-binding domain (e.g., any of the exemplary second target-binding domains described herein) includes a scFv or a single domain antibody.

In some embodiments of any of the multi-chain chimeric polypeptides described herein, one or both of the first target-binding domain (e.g., any of the exemplary target-binding domains described herein or known in the art) and the second target-binding domain (e.g., any of the exemplary target-binding domains described herein or known in the art) bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, a receptor for CD122, and a receptor for CD28.

In some embodiments of any of the multi-chain chimeric polypeptides described herein, one or both of the first target-binding domain (e.g., any of the exemplary target-binding domains described herein or known in the art) and the second target-binding domain (e.g., any of the exemplary target-binding domains described herein or known in the art) is a soluble interleukin or cytokine protein. Non-limiting examples of soluble interleukin proteins and soluble cytokine proteins include: IL-1, IL-2, IL-3, IL-7, IL-8, IL-10, IL-12, IL-15, IL-17, IL-18, IL-21, PDGF-DD, and SCF.

In some embodiments of any of the multi-chain chimeric polypeptides described herein, one or both of the first target-binding domain and the second target-binding domain (e.g., any of the exemplary target-binding domains described herein or known in the art) is a soluble interleukin or cytokine receptor. Non-limiting examples of soluble interleukin receptors and soluble cytokine receptors include: a soluble TGF-β receptor II (TGF-βRII), a soluble TGF-βRIII, a soluble NKG2D, a soluble NKp30, a soluble NKp44, a soluble NKp46, a soluble DNAM1, a scMHCI, a scMHCII, a scTCR, a soluble CD155, a soluble CD122, a soluble CD3, or a soluble CD28.

In some embodiments of any of the multi-chain chimeric polypeptides described herein, the first target-binding domain and the second target-binding domain can each, independently, bind specifically to a target selected from the group of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

In some embodiments of any of the multi-chain chimeric polypeptides described herein, one or both of the first target-binding domain and the second target-binding domain is a soluble interleukin or cytokine protein. In some embodiments of any of the multi-chain chimeric polypeptides described herein, the soluble interleukin or cytokine protein is selected from the group of: IL-1, IL-2, IL-3, IL-7, IL-8, IL-10, IL-12, IL-15, IL-17, IL-18, IL-21, PDGF-DD, and SCF.

In some embodiments of any of the multi-chain chimeric polypeptides described herein, one or both of the first target-binding domain and the second target-binding domain is a soluble interleukin or cytokine receptor. In some embodiments of any of the multi-chain chimeric polypeptides described herein, the soluble receptor is a soluble TGF-β receptor II (TGF-βRII) a soluble TGF-βRIII, a soluble receptor for TNFα, a soluble receptor for IL-4, or a soluble receptor for IL-10.

Tissue Factor

Human tissue factor is a 263 amino-acid transmembrane protein containing three domains: (1) a 219-amino acid N-terminal extracellular domain (residues 1-219); (2) a 22-amino acid transmembrane domain (residues 220-242); and (3) a 21-amino acid cytoplasmic C-terminal tail (residues 242-263) ((UniProtKB Identifier Number: P13726).

The cytoplasmic tail contains two phosphorylation sites at Ser253 and Ser258, and one S-palmitoylation site at Cys245. Deletion or mutation of the cytoplasmic domain was not found to affect tissue factor coagulation activity. Tissue factor has one S-palmitoylation site in the intracellular domain of the protein at Cys245. The Cys245 is located at the amino acid terminus of the intracellular domain and close to the membrane surface. The tissue factor transmembrane domain is composed of a single-spanning α-helix.

The extracellular domain of tissue factor, composed of two fibronectin type III domains, is connected to the transmembrane domain through a six-amino acid linker. This linker provides conformational flexibility to decouple the tissue factor extracellular domain from its transmembrane and cytoplasmic domains. Each tissue factor fibronectin type III module is composed of two overlapping β sheets with the top sheet domain containing three antiparallel β-strands and the bottom sheet containing four β-strands. The β-strands are connected by β-loops between strand βA and βB, βC and βD, and βE and βF, all of which are conserved in conformation in the two modules. There are three short α-helix segments connecting the β-strands. A unique feature of tissue factor is a 17-amino acid β-hairpin between strand β10 and strand β11, which is not a common element of the fibronectin superfamily. The N-terminal domain also contains a 12 amino acid loop between β6F and β7G that is not present in the C-terminal domain and is unique to tissue factor. Such a fibronectin type III domain structure is a feature of the immunoglobulin-like family of protein folds and is conserved among a wide variety of extracellular proteins.

The zymogen FVII is rapidly converted to FVIIa by limited proteolysis once it binds to tissue to form the active tissue factor-FVIIa complex. The FVIIa, which circulates as an enzyme at a concentration of approximately 0.1 nM (1% of plasma FVII), can also bind directly to tissue factor. The allosteric interaction between tissue factor and FVIIa on the tissue factor-FVIIa complex greatly increases the enzymatic activity of FVIIa: an approximate 20- to 100-fold increase in the rate of hydrolysis of small, chromogenic peptidyl substrates, and nearly a million-fold increase in the rate of activation of the natural macromolecular substrates FIX and FX. In concert with allosteric activation of the active site of FVIIa upon binding to tissue factor, the formation of tissue factor-FVIIa complex on phospholipid bilayer (i.e., upon exposure of phosphatidyl-L-serine on membrane surfaces) increases the rate of FIX or FX activation, in a $Ca^{2+}$-dependent manner, an additional 1,000-fold. The roughly million-fold overall increase in FX activation by tissue factor-FVIIa-phospholipid complex relative to free FVIIa is a critical regulatory point for the coagulation cascade.

FVII is a ~50 kDa, single-chain polypeptide consisting of 406 amino acid residues, with an N-terminal γ-carboxyglutamate-rich (GLA) domain, two epidermal growth factor-like domains (EGF1 and EFG2), and a C-terminal serine protease domain. FVII is activated to FVIIa by a specific proteolytic cleavage of the $Ile^{154}$-$Arg^{152}$ bond in the short linker region between the EGF2 and the protease domain. This cleavage results in the light and heavy chains being held together by a single disulfide bond of $Cys^{135}$ and $Cys^{262}$. FVIIa binds phospholipid membrane in a $Ca^{2+}$-dependent manner through its N-terminal GLA-domain. Immediately C-terminal to the GLA domain is an aromatic stack and two EGF domains. The aromatic stack connects the GLA to EGF1 domain which binds a single $Ca^{2+}$ ion. Occupancy of this $Ca^{2+}$-binding site increases FVIIa amidolytic activity and tissue factor association. The catalytic triad consist of $His^{193}$, $Asp^{242}$, and $Ser^{344}$, and binding of a single $Ca^{2+}$ ion within the FVIIa protease domain is critical for its catalytic activity. Proteolytic activation of FVII to FVIIa frees the newly formed amino terminus at $Ile^{153}$ to fold back and be inserted into the activation pocket forming a salt bridge with the carboxylate of $Asp^{343}$ to generate the oxyanion hole. Formation of this salt bridge is critical for FVIIa activity. However, oxyanion hole formation does not occur in free FVIIa upon proteolytic activation. As a result, FVIIa circulates in a zymogen-like state that is poorly recognized by plasma protease inhibitors, allowing it to circulate with a half-life of approximately 90 minutes.

Tissue factor-mediated positioning of the FVIIa active site above the membrane surface is important for FVIIa towards cognate substrates. Free FVIIa adopts a stable, extended structure when bound to the membrane with its active site positioned ~80 Å above the membrane surface. Upon FVIIa binding to tissue factor, the FVa active site is repositioned ~6 Å closer to the membrane. This modulation may aid in a proper alignment of the FVIIa catalytic triad with the target substrate cleavage site. Using GLA-domainless FVIIa, it has been shown that the active site was still positioned a similar distance above the membrane, demonstrating that tissue factor is able to fully support FVIIa active site positioning even in the absence of FVIIa-membrane interaction. Additional data showed that tissue factor supported full FVIIa proteolytic activity as long as the tissue factor extracellular domain was tethered in some way to the membrane surface. However, raising the active site of FVIIa greater than 80 Å above the membrane surface greatly reduced the ability of the tissue factor-FVIIa complex to activate FX but did not diminish tissue factor-FVIIa amidolytic activity.

Alanine scanning mutagenesis has been used to assess the role of specific amino acid side chains in the tissue factor extracellular domain for interaction with FVIIa (Gibbs et al., *Biochemistry* 33(47): 14003-14010, 1994; Schullek et al., *J Biol Chem* 269(30): 19399-19403, 1994). Alanine substitution identified a limited number of residue positions at which alanine replacements cause 5- to 10-fold lower affinity for FVIIa binding. Most of these residue side chains were found to be well-exposed to solvent in the crystal structure, concordant with macromolecular ligand interaction. The FVIIa ligand-binding site is located over an extensive region at the boundary between the two modules. In the C-module, residues $Arg^{135}$ and $Phe^{140}$ located on the protruding B-C loop provide an independent contact with FVIIa. $Leu^{133}$ is located at the base of the fingerlike structure and packed into the cleft between the two modules. This provides continuity to a major cluster of important binding residues consisting of $Lys^{20}$, $Thr^{60}$, $Asp^{58}$, and $Ile^{22}$. $Thr^{60}$ is only partially solvent-exposed and may play a local structural role rather than making a significant contact with ligand. The binding site extends onto the concave side of the intermodule angle involving $Glu^{24}$ and $Gln^{110}$, and potentially the more distant residue $Val^{207}$. The binding region extends from $Asp^{58}$ onto a convex surface area formed by $Lys^{48}$, $Lys^{46}$, $Gln^{37}$, $Asp^{44}$, and $Trp^{45}$. $Trp^{45}$ and $Asp^{44}$ do not interact independently with FVIIa, indicating that the mutational effect at the $Trp^{45}$ position may reflect a structural importance of this side chain for the local packing of the adjacent $Asp^{44}$ and $Gln^{37}$ side chain. The interactive area further includes two surface-exposed aromatic residues, $Phe^{76}$ and $Tyr^{78}$, which form part of the hydrophobic cluster in the N-module.

The known physiologic substrates of tissue factor-FVIIa are FVII, FIX, and FX and certain proteinase-activated receptors. Mutational analysis has identified a number of residues that, when mutated, support full FVIIa amidolytic activity towards small peptidyl substrates but are deficient in their ability to support macromolecular substrate (i.e., FVII, FIX, and FX) activation (Ruf et al., *J Biol Chem* 267(31): 22206-22210, 1992; Ruf et al., *J Biol Chem* 267(9): 6375-6381, 1992; Huang et al., *J Biol Chem* 271(36): 21752-21757, 1996; Kirchhofer et al., *Biochemistry* 39(25): 7380-7387, 2000). The tissue factor loop region at residues 159-165, and residues in or adjacent to this flexible loop have been shown to be critical for the proteolytic activity of the tissue factor-FVIIa complex. This defines the proposed substrate-binding exosite region of tissue factor that is quite distant from the FVIIa active site. A substitution of the glycine residue by a marginally bulkier residue alanine, significantly impairs tissue factor-FVIIa proteolytic activity. This suggests that the flexibility afforded by glycine is critical for the loop of residues 159-165 for tissue factor macromolecular substrate recognition.

The residues $Lys^{165}$ and $Lys^{166}$ have also been demonstrated to be important for substrate recognition and binding. Mutation of either of these residues to alanine results in a significant decrease in the tissue factor co-factor function. $Lys^{165}$ and $Lys^{166}$ face away from each other, with $Lys^{165}$ pointing towards FVIIa in most tissue factor-FVIIa structures, and $Lys^{166}$ pointing into the substrate binding exosite region in the crystal structure. Putative salt bridge formation between $Lys^{165}$ of and $Gla^{35}$ of FVIIa would support the notion that tissue factor interaction with the GLA domain of FVIIa modulates substrate recognition. These results suggest that the C-terminal portion of the tissue factor ectodomain directly interacts with the GLA-domain, the possible adjacent EGF1 domains, of FIX and FX, and that the presence of the FVIIa GLA-domain may modulate these interactions either directly or indirectly.

Soluble Tissue Factor Domain

In some embodiments of any of the polypeptides, compositions, or methods described herein, the soluble tissue factor domain can be a wildtype tissue factor polypeptide lacking the signal sequence, the transmembrane domain, and the intracellular domain. In some examples, the soluble tissue factor domain can be a tissue factor mutant, wherein a wildtype tissue factor polypeptide lacking the signal sequence, the transmembrane domain, and the intracellular domain, and has been further modified at selected amino acids. In some examples, the soluble tissue factor domain can be a soluble human tissue factor domain. In some examples, the soluble tissue factor domain can be a soluble mouse tissue factor domain. In some examples, the soluble tissue factor domain can be a soluble rat tissue factor domain. Non-limiting examples of soluble human tissue factor domains, a mouse soluble tissue factor domain, a rat soluble tissue factor domain, and mutant soluble tissue factor domains are shown below.

```
Exemplary Soluble Human Tissue Factor Domain
                                    (SEQ ID NO: 93)
SGTTNTVAAYNLTWKSTNFKTILEWEPKPVNQVYTVQISTKSGDWKSKCF

YTTDTECDLTDEIVKDVKQTYLARVFSYPAGNVESTGSAGEPLYENSPEF

TPYLETNLGQPTIQSFEQVGTKVNVTVEDERTLVRRNNTFLSLRDVFGKD

LIYTLYYWKSSSSGKKTAKTNTNEFLIDVDKGENYCFSVQAVIPSRTVNR

KSTDSPVECMGQEKGEFRE
```

```
Exemplary Nucleic Acid Encoding Soluble Human
Tissue Factor Domain
                                    (SEQ ID NO: 94)
AGCGGCACAACCAACACAGTCGCTGCCTATAACCTCACTTGGAAGAGCAC

CAACTTCAAAACCATCCTCGAATGGGAACCCAAACCCGTTAACCAAGTTT

ACACCGTGCAGATCAGCACCAAGTCCGGCGACTGGAAGTCCAAATGTTTC

TATACCACCGACACCGAGTGCGATCTCACCGATGAGATCGTGAAAGATGT

GAAACAGACCTACCTCGCCCGGGTGTTTAGCTACCCCGCCGGCAATGTGG

AGAGCACTGGTTCCGCTGGCGAGCCTTTATACGAGAACAGCCCCGAATTT

ACCCCTTACCTCGAGACCAATTTAGGACAGCCCACCATCCAAAGCTTTGA

GCAAGTTGGCACAAAGGTGAATGTGACAGTGGAGGACGAGCGGACTTTAG

TGCGGCGGAACAACACCTTTCTCAGCCTCCGGGATGTGTTCGGCAAAGAT

TTAATCTACACACTGTATTACTGGAAGTCCTCTTCCTCCGGCAAGAAGAC

AGCTAAAACCAACACAAACGAGTTTTTAATCGACGTGGATAAAGGCGAAA

ACTACTGTTTCAGCGTGCAAGCTGTGATCCCCTCCCGGACCGTGAATAGG

AAAAGCACCGATAGCCCCGTTGAGTGCATGGGCCAAGAAAAGGGCGAGTT

CCGGGAG
```

```
Exemplary Soluble Mouse Tissue Factor Domain
                                    (SEQ ID NO: 95)
agipekafnltwistdfktilewqpkptnytytvqisdrsrnwknkcfst tdtecdltdeivkdvtwayeakvlsvprrnsvhgdgdqlvihgeeppftn apkflpyrdtnlgqpviqqfeqdgrklnvvvkdsltlvrkngtfltlrqv fgkdlgyiityrkgsstgkktnitntnefsidveegvsycffvqamifsr ktnqnspgsstvcteqwksflge
```

```
Exemplary Soluble Rat Tissue Factor Domain
                                    (SEQ ID NO: 96)
Agtppgkafnltwistdfktilewqpkptnytytvqisdrsrnwkykctg ttdtecdltdeivkdvnwtyearvlsvpwrnsthgketlfgthgeeppft narkflpyrdtkigqpviqkyeqggtklkvtvkdsftlvrkngtfltlrq vfgndlgyiltyrkdsstgrktntthtneflidvekgvsycffaqavifs rktnhkspesitkcteqwksvlge
```

```
Exemplary Mutant Soluble Human Tissue Factor
Domain
                                    (SEQ ID NO: 97)
SGTTNTVAAYNLTWKSTNFATALEWEPKPVNQVYTVQISTKSGDWKSKCF

YTTDTECALTDEIVKDVKQTYLARVFSYPAGNVESTGSAGEPLYENSPEF

TPYLETNLGQPTIQSFEQVGTKVNVTVEDERTLVARNNTALSLRDVFGKD

LIYTLYYWKSSSSGKKTAKTNTNEFLIDVDKGENYCFSVQAVIPSRTVNR

KSTDSPVECMGQEKGEFRE
```

```
Exemplary Mutant Soluble Human Tissue Factor
Domain
                                    (SEQ ID NO: 98)
SGTTNTVAAYNLTWKSTNFATALEWEPKPVNQVYTVQISTKSGDAKSKCF

YTTDTECALTDEIVKDVKQTYLARVFSYPAGNVESTGSAGEPLAENSPEF

TPYLETNLGQPTIQSFEQVGTKVNVTVEDERTLVARNNTALSLRDVFGKD

LIYTLYYWKSSSSGKKTAKTNTNEFLIDVDKGENYCFSVQAVIPSRTVNR

KSTDSPVECMGQEKGEFRE
```

In some embodiments, a soluble tissue factor domain can include a sequence that is at least 70% identical, at least 72% identical, at least 74% identical, at least 76% identical, at least 78% identical, at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 93, 95, 96, 97 or 98. In some embodiments, a soluble tissue factor domain can include a sequence of SEQ ID NO: 93, 95, 96, 97, or 98, with one to twenty amino acids (e.g., 2, 3, 4, 5, 6, 7, 8, 9, 10, 11, 12, 13, 14, 15, 16, 17, 18, 19, or 20) amino acids removed from its N-terminus and/or one to twenty amino acids (e.g., 2, 3, 4, 5, 6, 7, 8, 9, 10, 11, 12, 13, 14, 15, 16, 17, 18, 19, or 20) amino acids removed from its C-terminus.

As can be appreciated in the art, one skilled in the art would understand that mutation of amino acids that are conserved between different mammalian species is more likely to decrease the activity and/or structural stability of the protein, while mutation of amino acids that are not conserved between different mammalian species is less likely to decrease the activity and/or structural stability of the protein.

In some examples of any of the multi-chain chimeric polypeptides described herein, the soluble tissue factor domain is not capable of binding to Factor VIIa. In some examples of any of the multi-chain chimeric polypeptides described herein, the soluble tissue factor domain does not convert inactive Factor X into Factor Xa. In some embodiments of any of the multi-chain chimeric polypeptides described herein, the multi-chain chimeric polypeptide does not stimulate blood coagulation in a mammal.

In some examples, the soluble tissue factor domain can be a soluble human tissue factor domain. In some embodiments, the soluble tissue factor domain can be a soluble mouse tissue factor domain. In some embodiments, the soluble tissue factor domain can be a soluble rat tissue factor domain.

In some examples, the soluble tissue factor domain does not include one or more (e.g., two, three, four, five, six, or seven) of: a lysine at an amino acid position that corresponds to amino acid position 20 of mature wildtype human tissue factor protein; an isoleucine at an amino acid position that corresponds to amino acid position 22 of mature wildtype human tissue factor protein; a tryptophan at an amino acid position that corresponds to amino acid position 45 of mature wildtype human tissue factor protein; an aspartic acid at an amino acid position that corresponds to amino acid position 58 of mature wildtype human tissue factor protein; a tyrosine at an amino acid position that corresponds to amino acid position 94 of mature wildtype human tissue factor protein; an arginine at an amino acid position that corresponds to amino acid position 135 of mature wildtype human tissue factor protein; and a phenylalanine at an amino acid position that corresponds to amino acid position 140 of mature wildtype human tissue factor protein. In some embodiments, the mutant soluble tissue factor possesses the amino acid sequence of SEQ ID NO: 97 or SEQ ID NO: 98.

In some examples, the soluble tissue factor domain can be encoded by a nucleic acid including a sequence that is at least 70% identical, at least 72% identical, at least 74% identical, at least 76% identical, at least 78% identical, at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 94.

In some embodiments, the soluble tissue factor domain can have a total length of about 20 amino acids to about 220 amino acids, about 20 amino acids to about 215 amino acids, about 20 amino acids to about 210 amino acids, about 20 amino acids to about 205 amino acids, about 20 amino acids to about 200 amino acids, about 20 amino acids to about 195 amino acids, about 20 amino acids to about 190 amino acids, about 20 amino acids to about 185 amino acids, about 20 amino acids to about 180 amino acids, about 20 amino acids to about 175 amino acids, about 20 amino acids to about 170 amino acids, about 20 amino acids to about 165 amino acids, about 20 amino acids to about 160 amino acids, about 20 amino acids to about 155 amino acids, about 20 amino acids to about 150 amino acids, about 20 amino acids to about 145 amino acids, about 20 amino acids to about 140 amino acids, about 20 amino acids to about 135 amino acids, about 20 amino acids to about 130 amino acids, about 20 amino acids to about 125 amino acids, about 20 amino acids to about 120 amino acids, about 20 amino acids to about 115 amino acids, about 20 amino acids to about 110 amino acids, about 20 amino acids to about 105 amino acids, about 20 amino acids to about 100 amino acids, about 20 amino acids to about 95 amino acids, about 20 amino acids to about 90 amino acids, about 20 amino acids to about 85 amino acids, about 20 amino acids to about 80 amino acids, about 20 amino acids to about 75 amino acids, about 20 amino acids to about 70 amino acids, about 20 amino acids to about 60 amino acids, about 20 amino acids to about 50 amino acids, about 20 amino acids to about 40 amino acids, about 20 amino acids to about 30 amino acids, about 30 amino acids to about 220 amino acids, about 30 amino acids to about 215 amino acids, about 30 amino acids to about 210 amino acids, about 30 amino acids to about 205 amino acids, about 30 amino acids to about 200 amino acids, about 30 amino acids to about 195 amino acids, about 30 amino acids to about 190 amino acids, about 30 amino acids to about 185 amino acids, about 30 amino acids to about 180 amino acids, about 30 amino acids to about 175 amino acids, about 30 amino acids to about 170 amino acids, about 30 amino acids to about 165 amino acids, about 30 amino acids to about 160 amino acids, about 30 amino acids to about 155 amino acids, about 30 amino acids to about 150 amino acids, about 30 amino acids to about 145 amino acids, about 30 amino acids to about 140 amino acids, about 30 amino acids to about 135 amino acids, about 30 amino acids to about 130 amino acids, about 30 amino acids to about 125 amino acids, about 30 amino acids to about 120 amino acids, about 30 amino acids to about 115 amino acids, about 30 amino acids to about 110 amino acids, about 30 amino acids to about 105 amino acids, about 30 amino acids to about 100 amino acids, about 30 amino acids to about 95 amino acids, about 30 amino acids to about 90 amino acids, about 30 amino acids to about 85 amino acids, about 30 amino acids to about 80 amino acids, about 30 amino acids to about 75 amino acids, about 30 amino acids to about 70 amino acids, about 30 amino acids to about 60 amino acids, about 30 amino acids to about 50 amino acids, about 30 amino acids to about 40 amino acids, about 40 amino acids to about 220 amino acids, about 40 amino acids to about 215 amino acids, about 40 amino acids to about 210 amino acids, about 40 amino acids to about 205 amino acids, about 40 amino acids to about 200 amino acids, about 40 amino acids to about 195 amino acids, about 40 amino acids to about 190 amino acids, about 40 amino acids to about 185 amino acids, about 40 amino acids to about 180 amino acids, about 40 amino acids to about 175 amino acids, about 40 amino acids to about 170 amino acids, about 40 amino acids to about 165 amino acids, about 40 amino acids to about 160 amino acids, about 40 amino acids to about 155 amino acids, about 40 amino acids to about 150 amino acids, about 40 amino acids to about 145 amino acids, about 40 amino acids to about 140 amino acids, about 40 amino acids to about 135 amino acids, about 40 amino acids to about 130 amino acids, about 40 amino acids to about 125 amino acids, about 40 amino acids to about 120 amino acids, about 40 amino acids to about 115 amino acids, about 40 amino acids to about 110 amino acids, about 40 amino acids to about 105 amino acids, about 40 amino acids to about 100 amino acids, about 40 amino acids to about 95 amino acids, about 40 amino acids to about 90 amino acids, about 40 amino acids to about 85 amino acids, about 40 amino acids to about 80 amino acids, about 40 amino acids to about 75 amino acids, about 40 amino acids to about 70 amino acids, about 40 amino acids to about 60 amino acids, about 40 amino acids to about 50 amino acids, about 50 amino acids to about 220 amino acids, about 50 amino acids to about 215 amino acids, about 50 amino acids to about 210 amino acids, about 50 amino acids to about 205 amino acids, about 50 amino acids to about 200 amino acids, about 50 amino acids to about 195 amino acids, about 50 amino acids to about 190 amino acids, about 50 amino acids to about 185 amino acids, about 50 amino acids to about 180 amino acids, about 50 amino acids to about 175 amino acids, about 50 amino acids to about 170 amino acids, about 50 amino acids to about 165 amino acids, about 50 amino acids to about 160 amino acids, about 50 amino acids to about 155 amino acids, about 50 amino acids to about 150 amino acids, about 50 amino acids to about 145 amino acids, about 50 amino acids to about 140 amino acids, about 50 amino acids to about 135 amino acids, about 50 amino acids to about 130 amino acids, about 50 amino acids to about 125 amino acids, about 50 amino acids to about 120 amino acids, about 50 amino acids to about 115 amino acids, about 50 amino acids to about 110 amino acids, about 50 amino acids to about 105 amino acids, about 50 amino acids to about 100 amino acids, about 50 amino acids to about 95 amino acids, about 50 amino acids to about 90 amino acids, about 50 amino acids to about 85 amino acids, about 50 amino acids to about 80 amino acids, about 50 amino acids to about 75 amino acids, about 50 amino acids to about 70 amino acids, about 50 amino acids to about 60 amino acids, about 60 amino acids to about 220 amino acids, about 60 amino acids to about 215 amino acids, about 60 amino acids to about 210 amino acids, about 60 amino acids to about 205 amino acids, about 60 amino acids to about 200 amino acids, about 60 amino acids to about 195 amino acids, about 60 amino acids to about 190 amino acids, about 60 amino acids to about 185 amino acids, about 60 amino acids to about 180 amino acids, about 60 amino acids to about 175 amino acids, about 60 amino acids to about 170 amino acids, about 60 amino acids to about 165 amino acids, about 60 amino acids to about 160 amino acids, about 60 amino acids to about 155 amino acids, about 60 amino acids to about 150 amino acids, about 60 amino acids to about 145 amino acids, about 60 amino acids to about 140 amino acids, about 60 amino acids to about 135 amino acids, about 60 amino acids to about 130 amino acids, about 60 amino acids to about 125 amino acids, about 60 amino acids to about 120 amino acids, about 60 amino acids to about 115 amino acids, about 60 amino acids to about 110 amino acids, about 60 amino acids to about 105 amino acids, about 60 amino acids to about 100 amino acids, about 60 amino acids to about 95 amino acids, about 60 amino acids to about 90 amino acids, about 60 amino acids to about 85 amino acids, about 60 amino acids to about 80 amino acids, about 60 amino acids to about 75 amino acids, about 60 amino acids to about 70 amino acids, about 70 amino acids to about 220 amino acids, about 70 amino acids to about 215 amino acids, about 70 amino acids to about 210 amino acids, about 70 amino acids to about 205 amino acids, about 70 amino acids to about 200 amino acids, about 70 amino acids to about 195 amino acids, about 70 amino acids to about 190 amino acids, about 70 amino acids to about 185 amino acids, about 70 amino acids to about 180 amino acids, about 70 amino acids to about 175 amino acids, about 70 amino acids to about 170 amino acids, about 70 amino acids to about 165 amino acids, about 70 amino acids to about 160 amino acids, about 70 amino acids to about 155 amino acids, about 70 amino acids to about 150 amino acids, about 70 amino acids to about 145 amino acids, about 70 amino acids to about 140 amino acids, about 70 amino acids to about 135 amino acids, about 70 amino acids to about 130 amino acids, about 70 amino acids to about 125 amino acids, about 70 amino acids to about 120 amino acids, about 70 amino acids to about 115 amino acids, about 70 amino acids to about 110 amino acids, about 70 amino acids to about 105 amino acids, about 70 amino acids to about 100 amino acids, about 70 amino acids to about 95 amino acids, about 70 amino acids to about 90 amino acids, about 70 amino acids to about 85 amino acids, about 70 amino acids to about 80 amino acids, about 80 amino acids to about 220 amino acids, about 80 amino acids to about 215 amino acids, about 80 amino acids to about 210 amino acids, about 80 amino acids to about 205 amino acids, about 80 amino acids to about 200 amino acids, about 80 amino acids to about 195 amino acids, about 80 amino acids to about 190 amino acids, about 80 amino acids to about 185 amino acids, about 80 amino acids to about 180 amino acids, about 80 amino acids to about 175 amino acids, about 80 amino acids to about 170 amino acids, about 80 amino acids to about 165 amino acids, about 80 amino acids to about 160 amino acids, about 80 amino acids to about 155 amino acids, about 80 amino acids to about 150 amino acids, about 80 amino acids to about 145 amino acids, about 80 amino acids to about 140 amino acids, about 80 amino acids to about 135 amino acids, about 80 amino acids to about 130 amino acids, about 80 amino acids to about 125 amino acids, about 80 amino acids to about 120 amino acids, about 80 amino acids to about 115 amino acids, about 80 amino acids to about 110 amino acids, about 80 amino acids to about 105 amino acids, about 80 amino acids to about 100 amino acids, about 80 amino acids to about 95 amino acids, about 80 amino acids to about 90 amino acids, about 90 amino acids to about 220 amino acids, about 90 amino acids to about 215 amino acids, about 90 amino acids to about 210 amino acids, about 90 amino acids to about 205 amino acids, about 90 amino acids to about 200 amino acids, about 90 amino acids to about 195 amino acids, about 90 amino acids to about 190 amino acids, about 90 amino acids to about 185 amino acids, about 90 amino acids to about 180 amino acids, about 90 amino acids to about 175 amino acids, about 90 amino acids to about 170 amino acids, about 90 amino acids to about 165 amino acids, about 90 amino acids to about 160 amino acids, about 90 amino acids to about 155 amino acids, about 90 amino acids to about 150 amino acids, about 90 amino acids to about 145 amino acids, about 90 amino acids to about 140 amino acids, about 90 amino acids to about 135 amino acids, about 90 amino acids to about 130 amino acids, about 90 amino acids to about 125 amino acids, about 90 amino acids to about 120 amino acids, about 90 amino acids to about 115 amino acids, about 90 amino acids to about 110 amino acids, about 90 amino acids to about 105 amino acids, about 90 amino acids to about 100 amino acids, about 100 amino acids to about 220 amino acids, about 100 amino acids to about 215 amino acids, about 100 amino acids to about 210 amino acids, about 100 amino acids to about 205 amino acids, about 100 amino acids to about 200 amino acids, about 100 amino acids to about 195 amino acids, about 100 amino acids to about 190 amino acids, about 100 amino acids to about 185 amino acids, about 100 amino acids to about 180 amino acids, about 100 amino acids to about 175 amino acids, about 100 amino acids to about 170 amino acids, about 100 amino acids to about 165 amino acids, about 100 amino acids to about 160 amino acids, about 100 amino acids to about 155 amino acids, about 100 amino acids to about 150 amino acids, about 100 amino acids to about 145 amino acids, about 100 amino acids to about 140 amino acids, about 100 amino acids to about 135 amino acids, about 100 amino acids to about 130 amino acids, about 100 amino acids to about 125 amino acids, about 100 amino acids to about 120 amino acids, about 100 amino acids to about 115 amino acids, about 100 amino acids to about 110 amino acids, about 110 amino acids to about 220 amino acids, about 110 amino acids to about 215 amino acids, about 110 amino acids to about 210 amino acids, about 110 amino acids to about 205 amino acids, about 110 amino acids to about 200 amino acids, about 110 amino acids to about 195 amino acids, about 110 amino acids to about 190 amino acids, about 110 amino acids to about 185 amino acids, about 110 amino acids to about 180 amino acids, about 110 amino acids to about 175 amino acids, about 110 amino acids to about 170 amino acids, about 110 amino acids to about 165 amino acids, about 110 amino acids to about 160 amino acids, about 110 amino acids to about 155 amino acids, about 110 amino acids to about 150 amino acids, about 110 amino acids to about 145 amino acids, about 110 amino acids to about 140 amino acids, about 110 amino acids to about 135 amino acids, about 110 amino acids to about 130 amino acids, about 110 amino acids to about 125 amino acids, about 110 amino acids to about 120 amino acids, about 110 amino acids to about 115 amino acids, about 115 amino acids to about 220 amino acids, about 115 amino acids to about 215 amino acids, about 115 amino acids to about 210 amino acids, about 115 amino acids to about 205 amino acids, about 115 amino acids to about 200 amino acids, about 115 amino acids to about 195 amino acids, about 115 amino acids to about 190 amino acids, about 115 amino acids to about 185 amino acids, about 115 amino acids to about 180 amino acids, about 115 amino acids to about 175 amino acids, about 115 amino acids to about 170 amino acids, about 115 amino acids to about 165 amino acids, about 115 amino acids to about 160 amino acids, about 115 amino acids to about 155 amino acids, about 115 amino acids to about 150 amino acids, about 115 amino acids to about 145 amino acids, about 115 amino acids to about 140 amino acids, about 115 amino acids to about 135 amino acids, about 115 amino acids to about 130 amino acids, about 115 amino acids to about 125 amino acids, about 115 amino acids to about 120 amino acids, about 120 amino acids to about 220 amino acids, about 120 amino acids to about 215 amino acids, about 120 amino acids to about 210 amino acids, about 120 amino acids to about 205 amino acids, about 120 amino acids to about 200 amino acids, about 120 amino acids to about 195 amino acids, about 120 amino acids to about 190 amino acids, about 120 amino acids to about 185 amino acids, about 120 amino acids to about 180 amino acids, about 120 amino acids to about 175 amino acids, about 120 amino acids to about 170 amino acids, about 120 amino acids to about 165 amino acids, about 120 amino acids to about 160 amino acids, about 120 amino acids to about 155 amino acids, about 120 amino acids to about 150 amino acids, about 120 amino acids to about 145 amino acids, about 120 amino acids to about 140 amino acids, about 120 amino acids to about 135 amino acids, about 120 amino acids to about 130 amino acids, about 120 amino acids to about 125 amino acids, about 125 amino acids to about 220 amino acids, about 125 amino acids to about 215 amino acids, about 125 amino acids to about 210 amino acids, about 125 amino acids to about 205 amino acids, about 125 amino acids to about 200 amino acids, about 125 amino acids to about 195 amino acids, about 125 amino acids to about 190 amino acids, about 125 amino acids to about 185 amino acids, about 125 amino acids to about 180 amino acids, about 125 amino acids to about 175 amino acids, about 125 amino acids to about 170 amino acids, about 125 amino acids to about 165 amino acids, about 125 amino acids to about 160 amino acids, about 125 amino acids to about 155 amino acids, about 125 amino acids to about 150 amino acids, about 125 amino acids to about 145 amino acids, about 125 amino acids to about 140 amino acids, about 125 amino acids to about 135 amino acids, about 125 amino acids to about 130 amino acids, about 130 amino acids to about 220 amino acids, about 130 amino acids to about 215 amino acids, about 130 amino acids to about 210 amino acids, about 130 amino acids to about 205 amino acids, about 130 amino acids to about 200 amino acids, about 130 amino acids to about 195 amino acids, about 130 amino acids to about 190 amino acids, about 130 amino acids to about 185 amino acids, about 130 amino acids to about 180 amino acids, about 130 amino acids to about 175 amino acids, about 130 amino acids to about 170 amino acids, about 130 amino acids to about 165 amino acids, about 130 amino acids to about 160 amino acids, about 130 amino acids to about 155 amino acids, about 130 amino acids to about 150 amino acids, about 130 amino acids to about 145 amino acids, about 130 amino acids to about 140 amino acids, about 130 amino acids to about 135 amino acids, about 135 amino acids to about 220 amino acids, about 135 amino acids to about 215 amino acids, about 135 amino acids to about 210 amino acids, about 135 amino acids to about 205 amino acids, about 135 amino acids to about 200 amino acids, about 135 amino acids to about 195 amino acids, about 135 amino acids to about 190 amino acids, about 135 amino acids to about 185 amino acids, about 135 amino acids to about 180 amino acids, about 135 amino acids to about 175 amino acids, about 135 amino acids to about 170 amino acids, about 135 amino acids to about 165 amino acids, about 135 amino acids to about 160 amino acids, about 135 amino acids to about 155 amino acids, about 135 amino acids to about 150 amino acids, about 135 amino acids to about 145 amino acids, about 135 amino acids to about 140 amino acids, about 140 amino acids to about 220 amino acids, about 140 amino acids to about 215 amino acids, about 140 amino acids to about 210 amino acids, about 140 amino acids to about 205 amino acids, about 140 amino acids to about 200 amino acids, about 140 amino acids to about 195 amino acids, about 140 amino acids to about 190 amino acids, about 140 amino acids to about 185 amino acids, about 140 amino acids to about 180 amino acids, about 140 amino acids to about 175 amino acids, about 140 amino acids to about 170 amino acids, about 140 amino acids to about 165 amino acids, about 140 amino acids to about 160 amino acids, about 140 amino acids to about 155 amino acids, about 140 amino acids to about 150 amino acids, about 140 amino acids to about 145 amino acids, about 145 amino acids to about 220 amino acids, about 145 amino acids to about 215 amino acids, about 145 amino acids to about 210 amino acids, about 145 amino acids to about 205 amino acids, about 145 amino acids to about 200 amino acids, about 145 amino acids to about 195 amino acids, about 145 amino acids to about 190 amino acids, about 145 amino acids to about 185 amino acids, about 145 amino acids to about 180 amino acids, about 145 amino acids to about 175 amino acids, about 145 amino acids to about 170 amino acids, about 145 amino acids to about 165 amino acids, about 145 amino acids to about 160 amino acids, about 145 amino acids to about 155 amino acids, about 145 amino acids to about 150 amino acids, about 150 amino acids to about 220 amino acids, about 150 amino acids to about 215 amino acids, about 150 amino acids to about 210 amino acids, about 150 amino acids to about 205 amino acids, about 150 amino acids to about 200 amino acids, about 150 amino acids to about 195 amino acids, about 150 amino acids to about 190 amino acids, about 150 amino acids to about 185 amino acids, about 150 amino acids to about 180 amino acids, about 150 amino acids to about 175 amino acids, about 150 amino acids to about 170 amino acids, about 150 amino acids to about 165 amino acids, about 150 amino acids to about 160 amino acids, about 150 amino acids to about 155 amino acids, about 155 amino acids to about 220 amino acids, about 155 amino acids to about 215 amino acids, about 155 amino acids to about 210 amino acids, about 155 amino acids to about 205 amino acids, about 155 amino acids to about 200 amino acids, about 155 amino acids to about 195 amino acids, about 155 amino acids to about 190 amino acids, about 155 amino acids to about 185 amino acids, about 155 amino acids to about 180 amino acids, about 155 amino acids to about 175 amino acids, about 155 amino acids to about 170 amino acids, about 155 amino acids to about 165 amino acids, about 155 amino acids to about 160 amino acids, about 160 amino acids to about 220 amino acids, about 160 amino acids to about 215 amino acids, about 160 amino acids to about 210 amino acids, about 160 amino acids to about 205 amino acids, about 160 amino acids to about 200 amino acids, about 160 amino acids to about 195 amino acids, about 160 amino acids to about 190 amino acids, about 160 amino acids to about 185 amino acids, about 160 amino acids to about 180 amino acids, about 160 amino acids to about 175 amino acids, about 160 amino acids to about 170 amino acids, about 160 amino acids to about 165 amino acids, about 165 amino acids to about 220 amino acids, about 165 amino acids to about 215 amino acids, about 165 amino acids to about 210 amino acids, about 165 amino acids to about 205 amino acids, about 165 amino acids to about 200 amino acids, about 165 amino acids to about 195 amino acids, about 165 amino acids to about 190 amino acids, about 165 amino acids to about 185 amino acids, about 165 amino acids to about 180 amino acids, about 165 amino acids to about 175 amino acids, about 165 amino acids to about 170 amino acids, about 170 amino acids to about 220 amino acids, about 170 amino acids to about 215 amino acids, about 170 amino acids to about 210 amino acids, about 170 amino acids to about 205 amino acids, about 170 amino acids to about 200 amino acids, about 170 amino acids to about 195 amino acids, about 170 amino acids to about 190 amino acids, about 170 amino acids to about 185 amino acids, about 170 amino acids to about 180 amino acids, about 170 amino acids to about 175 amino acids, about 175 amino acids to about 220 amino acids, about 175 amino acids to about 215 amino acids, about 175 amino acids to about 210 amino acids, about 175 amino acids to about 205 amino acids, about 175 amino acids to about 200 amino acids, about 175 amino acids to about 195 amino acids, about 175 amino acids to about 190 amino acids, about 175 amino acids to about 185 amino acids, about 175 amino acids to about 180 amino acids, about 180 amino acids to about 220 amino acids, about 180 amino acids to about 215 amino acids, about 180 amino acids to about 210 amino acids, about 180 amino acids to about 205 amino acids, about 180 amino acids to about 200 amino acids, about 180 amino acids to about 195 amino acids, about 180 amino acids to about 190 amino acids, about 180 amino acids to about 185 amino acids, about 185 amino acids to about 220 amino acids, about 185 amino acids to about 215 amino acids, about 185 amino acids to about 210 amino acids, about 185 amino acids to about 205 amino acids, about 185 amino acids to about 200 amino acids, about 185 amino acids to about 195 amino acids, about 185 amino acids to about 190 amino acids, about 190 amino acids to about 220 amino acids, about 190 amino acids to about 215 amino acids, about 190 amino acids to about 210 amino acids, about 190 amino acids to about 205 amino acids, about 190 amino acids to about 200 amino acids, about 190 amino acids to about 195 amino acids, about 195 amino acids to about 220 amino acids, about 195 amino acids to about 215 amino acids, about 195 amino acids to about 210 amino acids, about 195 amino acids to about 205 amino acids, about 195 amino acids to about 200 amino acids, about 200 amino acids to about 220 amino acids, about 200 amino acids to about 215 amino acids, about 200 amino acids to about 210 amino acids, about 200 amino acids to about 205 amino acids, about 205 amino acids to about 220 amino acids, about 205 amino acids to about 215 amino acids, about 205 amino acids to about 210 amino acids, about 210 amino acids to about 220 amino acids, about 210 amino acids to about 215 amino acids, or about 215 amino acids to about 220 amino acids.

Linker Sequences

In some embodiments, the linker sequence can be a flexible linker sequence. Non-limiting examples of linker sequences that can be used are described in Klein et al., *Protein Engineering, Design & Selection* 27(10):325-330, 2014; Priyanka et al., *Protein Sci.* 22(2):153-167, 2013. In some examples, the linker sequence is a synthetic linker sequence.

In some embodiments of any of the single-chain chimeric polypeptides described herein can include one, two, three, four, five, six, seven, eight, nine, or ten linker sequence(s) (e.g., the same or different linker sequences, e.g., any of the exemplary linker sequences described herein or known in the art). In some embodiments of any of the single-chain chimeric polypeptides described herein can include one, two, three, four, five, six, seven, eight, nine, or ten linker sequence(s) (e.g., the same or different linker sequences, e.g., any of the exemplary linker sequences described herein or known in the art).

In some embodiments of any of the multi-chain chimeric polypeptides described herein, the first chimeric polypeptide can include one, two, three, four, five, six, seven, eight, nine, or ten linker sequence(s) (e.g., the same or different linker sequences, e.g., any of the exemplary linker sequences described herein or known in the art). In some embodiments of any of the multi-chain chimeric polypeptides described herein, the second chimeric polypeptide can include one, two, three, four, five, six, seven, eight, nine, or ten linker sequence(s) (e.g., the same or different linker sequences, e.g., any of the exemplary linker sequences described herein or known in the art).

In some embodiments, a linker sequence can have a total length of 1 amino acid to about 100 amino acids, 1 amino acid to about 90 amino acids, 1 amino acid to about 80 amino acids, 1 amino acid to about 70 amino acids, 1 amino acid to about 60 amino acids, 1 amino acid to about 50 amino acids, 1 amino acid to about 45 amino acids, 1 amino acid to about 40 amino acids, 1 amino acid to about 35 amino acids, 1 amino acid to about 30 amino acids, 1 amino acid to about 25 amino acids, 1 amino acid to about 24 amino acids, 1 amino acid to about 22 amino acids, 1 amino acid to about 20 amino acids, 1 amino acid to about 18 amino acids, 1 amino acid to about 16 amino acids, 1 amino acid to about 14 amino acids, 1 amino acid to about 12 amino acids, 1 amino acid to about 10 amino acids, 1 amino acid to about 8 amino acids, 1 amino acid to about 6 amino acids, 1 amino acid to about 4 amino acids, about 2 amino acids to about 100 amino acids, about 2 amino acids to about 90 amino acids, about 2 amino acids to about 80 amino acids, about 2 amino acids to about 70 amino acids, about 2 amino acids to about 60 amino acids, about 2 amino acids to about 50 amino acids, about 2 amino acids to about 45 amino acids, about 2 amino acids to about 40 amino acids, about 2 amino acids to about 35 amino acids, about 2 amino acids to about 30 amino acids, about 2 amino acids to about 25 amino acids, about 2 amino acids to about 24 amino acids, about 2 amino acids to about 22 amino acids, about 2 amino acids to about 20 amino acids, about 2 amino acids to about 18 amino acids, about 2 amino acids to about 16 amino acids, about 2 amino acids to about 14 amino acids, about 2 amino acids to about 12 amino acids, about 2 amino acids to about 10 amino acids, about 2 amino acids to about 8 amino acids, about 2 amino acids to about 6 amino acids, about 2 amino acids to about 4 amino acids, about 4 amino acids to about 100 amino acids, about 4 amino acids to about 90 amino acids, about 4 amino acids to about 80 amino acids, about 4 amino acids to about 70 amino acids, about 4 amino acids to about 60 amino acids, about 4 amino acids to about 50 amino acids, about 4 amino acids to about 45 amino acids, about 4 amino acids to about 40 amino acids, about 4 amino acids to about 35 amino acids, about 4 amino acids to about 30 amino acids, about 4 amino acids to about 25 amino acids, about 4 amino acids to about 24 amino acids, about 4 amino acids to about 22 amino acids, about 4 amino acids to about 20 amino acids, about 4 amino acids to about 18 amino acids, about 4 amino acids to about 16 amino acids, about 4 amino acids to about 14 amino acids, about 4 amino acids to about 12 amino acids, about 4 amino acids to about 10 amino acids, about 4 amino acids to about 8 amino acids, about 4 amino acids to about 6 amino acids, about 6 amino acids to about 100 amino acids, about 6 amino acids to about 90 amino acids, about 6 amino acids to about 80 amino acids, about 6 amino acids to about 70 amino acids, about 6 amino acids to about 60 amino acids, about 6 amino acids to about 50 amino acids, about 6 amino acids to about 45 amino acids, about 6 amino acids to about 40 amino acids, about 6 amino acids to about 35 amino acids, about 6 amino acids to about 30 amino acids, about 6 amino acids to about 25 amino acids, about 6 amino acids to about 24 amino acids, about 6 amino acids to about 22 amino acids, about 6 amino acids to about 20 amino acids, about 6 amino acids to about 18 amino acids, about 6 amino acids to about 16 amino acids, about 6 amino acids to about 14 amino acids, about 6 amino acids to about 12 amino acids, about 6 amino acids to about 10 amino acids, about 6 amino acids to about 8 amino acids, about 8 amino acids to about 100 amino acids, about 8 amino acids to about 90 amino acids, about 8 amino acids to about 80 amino acids, about 8 amino acids to about 70 amino acids, about 8 amino acids to about 60 amino acids, about 8 amino acids to about 50 amino acids, about 8 amino acids to about 45 amino acids, about 8 amino acids to about 40 amino acids, about 8 amino acids to about 35 amino acids, about 8 amino acids to about 30 amino acids, about 8 amino acids to about 25 amino acids, about 8 amino acids to about 24 amino acids, about 8 amino acids to about 22 amino acids, about 8 amino acids to about 20 amino acids, about 8 amino acids to about 18 amino acids, about 8 amino acids to about 16 amino acids, about 8 amino acids to about 14 amino acids, about 8 amino acids to about 12 amino acids, about 8 amino acids to about 10 amino acids, about 10 amino acids to about 100 amino acids, about 10 amino acids to about 90 amino acids, about 10 amino acids to about 80 amino acids, about 10 amino acids to about 70 amino acids, about 10 amino acids to about 60 amino acids, about 10 amino acids to about 50 amino acids, about 10 amino acids to about 45 amino acids, about 10 amino acids to about 40 amino acids, about 10 amino acids to about 35 amino acids, about 10 amino acids to about 30 amino acids, about 10 amino acids to about 25 amino acids, about 10 amino acids to about 24 amino acids, about 10 amino acids to about 22 amino acids, about 10 amino acids to about 20 amino acids, about 10 amino acids to about 18 amino acids, about 10 amino acids to about 16 amino acids, about 10 amino acids to about 14 amino acids, about 10 amino acids to about 12 amino acids, about 12 amino acids to about 100 amino acids, about 12 amino acids to about 90 amino acids, about 12 amino acids to about 80 amino acids, about 12 amino acids to about 70 amino acids, about 12 amino acids to about 60 amino acids, about 12 amino acids to about 50 amino acids, about 12 amino acids to about 45 amino acids, about 12 amino acids to about 40 amino acids, about 12 amino acids to about 35 amino acids, about 12 amino acids to about 30 amino acids, about 12 amino acids to about 25 amino acids, about 12 amino acids to about 24 amino acids, about 12 amino acids to about 22 amino acids, about 12 amino acids to about 20 amino acids, about 12 amino acids to about 18 amino acids, about 12 amino acids to about 16 amino acids, about 12 amino acids to about 14 amino acids, about 14 amino acids to about 100 amino acids, about 14 amino acids to about 90 amino acids, about 14 amino acids to about 80 amino acids, about 14 amino acids to about 70 amino acids, about 14 amino acids to about 60 amino acids, about 14 amino acids to about 50 amino acids, about 14 amino acids to about 45 amino acids, about 14 amino acids to about 40 amino acids, about 14 amino acids to about 35 amino acids, about 14 amino acids to about 30 amino acids, about 14 amino acids to about 25 amino acids, about 14 amino acids to about 24 amino acids, about 14 amino acids to about 22 amino acids, about 14 amino acids to about 20 amino acids, about 14 amino acids to about 18 amino acids, about 14 amino acids to about 16 amino acids, about 16 amino acids to about 100 amino acids, about 16 amino acids to about 90 amino acids, about 16 amino acids to about 80 amino acids, about 16 amino acids to about 70 amino acids, about 16 amino acids to about 60 amino acids, about 16 amino acids to about 50 amino acids, about 16 amino acids to about 45 amino acids, about 16 amino acids to about 40 amino acids, about 16 amino acids to about 35 amino acids, about 16 amino acids to about 30 amino acids, about 16 amino acids to about 25 amino acids, about 16 amino acids to about 24 amino acids, about 16 amino acids to about 22 amino acids, about 16 amino acids to about 20 amino acids, about 16 amino acids to about 18 amino acids, about 18 amino acids to about 100 amino acids, about 18 amino acids to about 90 amino acids, about 18 amino acids to about 80 amino acids, about 18 amino acids to about 70 amino acids, about 18 amino acids to about 60 amino acids, about 18 amino acids to about 50 amino acids, about 18 amino acids to about 45 amino acids, about 18 amino acids to about 40 amino acids, about 18 amino acids to about 35 amino acids, about 18 amino acids to about 30 amino acids, about 18 amino acids to about 25 amino acids, about 18 amino acids to about 24 amino acids, about 18 amino acids to about 22 amino acids, about 18 amino acids to about 20 amino acids, about 20 amino acids to about 100 amino acids, about 20 amino acids to about 90 amino acids, about 20 amino acids to about 80 amino acids, about 20 amino acids to about 70 amino acids, about 20 amino acids to about 60 amino acids, about 20 amino acids to about 50 amino acids, about 20 amino acids to about 45 amino acids, about 20 amino acids to about 40 amino acids, about 20 amino acids to about 35 amino acids, about 20 amino acids to about 30 amino acids, about 20 amino acids to about 25 amino acids, about 20 amino acids to about 24 amino acids, about 20 amino acids to about 22 amino acids, about 22 amino acids to about 100 amino acids, about 22 amino acids to about 90 amino acids, about 22 amino acids to about 80 amino acids, about 22 amino acids to about 70 amino acids, about 22 amino acids to about 60 amino acids, about 22 amino acids to about 50 amino acids, about 22 amino acids to about 45 amino acids, about 22 amino acids to about 40 amino acids, about 22 amino acids to about 35 amino acids, about 22 amino acids to about 30 amino acids, about 22 amino acids to about 25 amino acids, about 22 amino acids to about 24 amino acids, about 25 amino acids to about 100 amino acids, about 25 amino acids to about 90 amino acids, about 25 amino acids to about 80 amino acids, about 25 amino acids to about 70 amino acids, about 25 amino acids to about 60 amino acids, about 25 amino acids to about 50 amino acids, about 25 amino acids to about 45 amino acids, about 25 amino acids to about 40 amino acids, about 25 amino acids to about 35 amino acids, about 25 amino acids to about 30 amino acids, about 30 amino acids to about 100 amino acids, about 30 amino acids to about 90 amino acids, about 30 amino acids to about 80 amino acids, about 30 amino acids to about 70 amino acids, about 30 amino acids to about 60 amino acids, about 30 amino acids to about 50 amino acids, about 30 amino acids to about 45 amino acids, about 30 amino acids to about 40 amino acids, about 30 amino acids to about 35 amino acids, about 35 amino acids to about 100 amino acids, about 35 amino acids to about 90 amino acids, about 35 amino acids to about 80 amino acids, about 35 amino acids to about 70 amino acids, about 35 amino acids to about 60 amino acids, about 35 amino acids to about 50 amino acids, about 35 amino acids to about 45 amino acids, about 35 amino acids to about 40 amino acids, about 40 amino acids to about 100 amino acids, about 40 amino acids to about 90 amino acids, about 40 amino acids to about 80 amino acids, about 40 amino acids to about 70 amino acids, about 40 amino acids to about 60 amino acids, about 40 amino acids to about 50 amino acids, about 40 amino acids to about 45 amino acids, about 45 amino acids to about 100 amino acids, about 45 amino acids to about 90 amino acids, about 45 amino acids to about 80 amino acids, about 45 amino acids to about 70 amino acids, about 45 amino acids to about 60 amino acids, about 45 amino acids to about 50 amino acids, about 50 amino acids to about 100 amino acids, about 50 amino acids to about 90 amino acids, about 50 amino acids to about 80 amino acids, about 50 amino acids to about 70 amino acids, about 50 amino acids to about 60 amino acids, about 60 amino acids to about 100 amino acids, about 60 amino acids to about 90 amino acids, about 60 amino acids to about 80 amino acids, about 60 amino acids to about 70 amino acids, about 70 amino acids to about 100 amino acids, about 70 amino acids to about 90 amino acids, about 70 amino acids to about 80 amino acids, about 80 amino acids to about 100 amino acids, about 80 amino acids to about 90 amino acids, or about 90 amino acids to about 100 amino acids.

In some embodiments, the linker is rich in glycine (Gly or G) residues. In some embodiments, the linker is rich in serine (Ser or S) residues. In some embodiments, the linker is rich in glycine and serine residues. In some embodiments, the linker has one or more glycine-serine residue pairs (GS), e.g., 1, 2, 3, 4, 5, 6, 7, 8, 9, or 10 or more GS pairs. In some embodiments, the linker has one or more Gly-Gly-Gly-Ser (GGGS) (SEQ ID NO: 99) sequences, e.g., 1, 2, 3, 4, 5, 6, 7, 8, 9, or 10 or more GGGS (SEQ ID NO: 99) sequences. In some embodiments, the linker has one or more Gly-Gly-Gly-Gly-Ser (GGGGS) sequences, e.g., 1, 2, 3, 4, 5, 6, 7, 8, 9, or 10 or more GGGGS (SEQ ID NO: 100) sequences. In some embodiments, the linker has one or more Gly-Gly-Ser-Gly (GGSG) (SEQ ID NO: 101) sequences, e.g., 1, 2, 3, 4, 5, 6, 7, 8, 9, or 10 or more GGSG (SEQ ID NO: 101) sequences. In some embodiments, the linker comprises GGSSRSSSSGGGGSGGGG (SEQ ID NO: 222).

In some embodiments, the linker sequence can comprise or consist of GGGGSGGGGSGGGGS (SEQ ID NO: 102). In some embodiments, the linker sequence can be encoded by a nucleic acid comprising or consisting of: GGCGGTGGAGGATCCGGAGGAGGTGGCTCCGGCGGCGGAGGATCT (SEQ ID NO: 103). In some embodiments, the linker sequence can comprise or consist of: GGGSGGGS (SEQ ID NO: 104), Target-Binding Domains In some embodiments of any of the multi-chain chimeric polypeptides described herein, the first target-binding domain, the second target-binding domain, and/or the additional one or more target-binding domains can be an antigen-binding domain (e.g., any of the exemplary antigen-binding domains described herein or known in the art), a soluble interleukin or cytokine protein (e.g., any of the exemplary soluble interleukin proteins or soluble cytokine proteins described herein), and a soluble interleukin or cytokine receptor (e.g., any of the exemplary soluble interleukin receptors or soluble cytokine receptors described herein).

In some embodiments of any of the multi-chain chimeric polypeptides described herein, the first target-binding domain, the second target-binding domain, and/or the one or more additional target-binding domains can each independent have a total number of amino acids of about 5 amino acids to about 1000 amino acids, about 5 amino acids to about 950 amino acids, about 5 amino acids to about 900 amino acids, about 5 amino acids to about 850 amino acids, about 5 amino acids to about 800 amino acids, about 5 amino acids to about 750 amino acids, about 5 amino acids to about 700 amino acids, about 5 amino acids to about 650 amino acids, about 5 amino acids to about 600 amino acids, about 5 amino acids to about 550 amino acids, about 5 amino acids to about 500 amino acids, about 5 amino acids to about 450 amino acids, about 5 amino acids to about 400 amino acids, about 5 amino acids to about 350 amino acids, about 5 amino acids to about 300 amino acids, about 5 amino acids to about 280 amino acids, about 5 amino acids to about 260 amino acids, about 5 amino acids to about 240 amino acids, about 5 amino acids to about 220 amino acids, about 5 amino acids to about 200 amino acids, about 5 amino acids to about 195 amino acids, about 5 amino acids to about 190 amino acids, about 5 amino acids to about 185 amino acids, about 5 amino acids to about 180 amino acids, about 5 amino acids to about 175 amino acids, about 5 amino acids to about 170 amino acids, about 5 amino acids to about 165 amino acids, about 5 amino acids to about 160 amino acids, about 5 amino acids to about 155 amino acids, about 5 amino acids to about 150 amino acids, about 5 amino acids to about 145 amino acids, about 5 amino acids to about 140 amino acids, about 5 amino acids to about 135 amino acids, about 5 amino acids to about 130 amino acids, about 5 amino acids to about 125 amino acids, about 5 amino acids to about 120 amino acids, about 5 amino acids to about 115 amino acids, about 5 amino acids to about 110 amino acids, about 5 amino acids to about 105 amino acids, about 5 amino acids to about 100 amino acids, about 5 amino acids to about 95 amino acids, about 5 amino acids to about 90 amino acids, about 5 amino acids to about 85 amino acids, about 5 amino acids to about 80 amino acids, about 5 amino acids to about 75 amino acids, about 5 amino acids to about 70 amino acids, about 5 amino acids to about 65 amino acids, about 5 amino acids to about 60 amino acids, about 5 amino acids to about 55 amino acids, about 5 amino acids to about 50 amino acids, about 5 amino acids to about 45 amino acids, about 5 amino acids to about 40 amino acids, about 5 amino acids to about 35 amino acids, about 5 amino acids to about 30 amino acids, about 5 amino acids to about 25 amino acids, about 5 amino acids to about 20 amino acids, about 5 amino acids to about 15 amino acids, about 5 amino acids to about 10 amino acids, about 10 amino acids to about 1000 amino acids, about 10 amino acids to about 950 amino acids, about 10 amino acids to about 900 amino acids, about 10 amino acids to about 850 amino acids, about 10 amino acids to about 800 amino acids, about 10 amino acids to about 750 amino acids, about 10 amino acids to about 700 amino acids, about 10 amino acids to about 650 amino acids, about 10 amino acids to about 600 amino acids, about 10 amino acids to about 550 amino acids, about 10 amino acids to about 500 amino acids, about 10 amino acids to about 450 amino acids, about 10 amino acids to about 400 amino acids, about 10 amino acids to about 350 amino acids, about 10 amino acids to about 300 amino acids, about 10 amino acids to about 280 amino acids, about 10 amino acids to about 260 amino acids, about 10 amino acids to about 240 amino acids, about 10 amino acids to about 220 amino acids, about 10 amino acids to about 200 amino acids, about 10 amino acids to about 195 amino acids, about 10 amino acids to about 190 amino acids, about 10 amino acids to about 185 amino acids, about 10 amino acids to about 180 amino acids, about 10 amino acids to about 175 amino acids, about 10 amino acids to about 170 amino acids, about 10 amino acids to about 165 amino acids, about 10 amino acids to about 160 amino acids, about 10 amino acids to about 155 amino acids, about 10 amino acids to about 150 amino acids, about 10 amino acids to about 145 amino acids, about 10 amino acids to about 140 amino acids, about 10 amino acids to about 135 amino acids, about 10 amino acids to about 130 amino acids, about 10 amino acids to about 125 amino acids, about 10 amino acids to about 120 amino acids, about 10 amino acids to about 115 amino acids, about 10 amino acids to about 110 amino acids, about 10 amino acids to about 105 amino acids, about 10 amino acids to about 100 amino acids, about 10 amino acids to about 95 amino acids, about 10 amino acids to about 90 amino acids, about 10 amino acids to about 85 amino acids, about 10 amino acids to about 80 amino acids, about 10 amino acids to about 75 amino acids, about 10 amino acids to about 70 amino acids, about 10 amino acids to about 65 amino acids, about 10 amino acids to about 60 amino acids, about 10 amino acids to about 55 amino acids, about 10 amino acids to about 50 amino acids, about 10 amino acids to about 45 amino acids, about 10 amino acids to about 40 amino acids, about 10 amino acids to about 35 amino acids, about 10 amino acids to about 30 amino acids, about 10 amino acids to about 25 amino acids, about 10 amino acids to about 20 amino acids, about 10 amino acids to about 15 amino acids, about 15 amino acids to about 1000 amino acids, about 15 amino acids to about 950 amino acids, about 15 amino acids to about 900 amino acids, about 15 amino acids to about 850 amino acids, about 15 amino acids to about 800 amino acids, about 15 amino acids to about 750 amino acids, about 15 amino acids to about 700 amino acids, about 15 amino acids to about 650 amino acids, about 15 amino acids to about 600 amino acids, about 15 amino acids to about 550 amino acids, about 15 amino acids to about 500 amino acids, about 15 amino acids to about 450 amino acids, about 15 amino acids to about 400 amino acids, about 15 amino acids to about 350 amino acids, about 15 amino acids to about 300 amino acids, about 15 amino acids to about 280 amino acids, about 15 amino acids to about 260 amino acids, about 15 amino acids to about 240 amino acids, about 15 amino acids to about 220 amino acids, about 15 amino acids to about 200 amino acids, about 15 amino acids to about 195 amino acids, about 15 amino acids to about 190 amino acids, about 15 amino acids to about 185 amino acids, about 15 amino acids to about 180 amino acids, about 15 amino acids to about 175 amino acids, about 15 amino acids to about 170 amino acids, about 15 amino acids to about 165 amino acids, about 15 amino acids to about 160 amino acids, about 15 amino acids to about 155 amino acids, about 15 amino acids to about 150 amino acids, about 15 amino acids to about 145 amino acids, about 15 amino acids to about 140 amino acids, about 15 amino acids to about 135 amino acids, about 15 amino acids to about 130 amino acids, about 15 amino acids to about 125 amino acids, about 15 amino acids to about 120 amino acids, about 15 amino acids to about 115 amino acids, about 15 amino acids to about 110 amino acids, about 15 amino acids to about 105 amino acids, about 15 amino acids to about 100 amino acids, about 15 amino acids to about 95 amino acids, about 15 amino acids to about 90 amino acids, about 15 amino acids to about 85 amino acids, about 15 amino acids to about 80 amino acids, about 15 amino acids to about 75 amino acids, about 15 amino acids to about 70 amino acids, about 15 amino acids to about 65 amino acids, about 15 amino acids to about 60 amino acids, about 15 amino acids to about 55 amino acids, about 15 amino acids to about 50 amino acids, about 15 amino acids to about 45 amino acids, about 15 amino acids to about 40 amino acids, about 15 amino acids to about 35 amino acids, about 15 amino acids to about 30 amino acids, about 15 amino acids to about 25 amino acids, about 15 amino acids to about 20 amino acids, about 20 amino acids to about 1000 amino acids, about 20 amino acids to about 950 amino acids, about 20 amino acids to about 900 amino acids, about 20 amino acids to about 850 amino acids, about 20 amino acids to about 800 amino acids, about 20 amino acids to about 750 amino acids, about 20 amino acids to about 700 amino acids, about 20 amino acids to about 650 amino acids, about 20 amino acids to about 600 amino acids, about 20 amino acids to about 550 amino acids, about 20 amino acids to about 500 amino acids, about 20 amino acids to about 450 amino acids, about 20 amino acids to about 400 amino acids, about 20 amino acids to about 350 amino acids, about 20 amino acids to about 300 amino acids, about 20 amino acids to about 280 amino acids, about 20 amino acids to about 260 amino acids, about 20 amino acids to about 240 amino acids, about 20 amino acids to about 220 amino acids, about 20 amino acids to about 200 amino acids, about 20 amino acids to about 195 amino acids, about 20 amino acids to about 190 amino acids, about 20 amino acids to about 185 amino acids, about 20 amino acids to about 180 amino acids, about 20 amino acids to about 175 amino acids, about 20 amino acids to about 170 amino acids, about 20 amino acids to about 165 amino acids, about 20 amino acids to about 160 amino acids, about 20 amino acids to about 155 amino acids, about 20 amino acids to about 150 amino acids, about 20 amino acids to about 145 amino acids, about 20 amino acids to about 140 amino acids, about 20 amino acids to about 135 amino acids, about 20 amino acids to about 130 amino acids, about 20 amino acids to about 125 amino acids, about 20 amino acids to about 120 amino acids, about 20 amino acids to about 115 amino acids, about 20 amino acids to about 110 amino acids, about 20 amino acids to about 105 amino acids, about 20 amino acids to about 100 amino acids, about 20 amino acids to about 95 amino acids, about 20 amino acids to about 90 amino acids, about 20 amino acids to about 85 amino acids, about 20 amino acids to about 80 amino acids, about 20 amino acids to about 75 amino acids, about 20 amino acids to about 70 amino acids, about 20 amino acids to about 65 amino acids, about 20 amino acids to about 60 amino acids, about 20 amino acids to about 55 amino acids, about 20 amino acids to about 50 amino acids, about 20 amino acids to about 45 amino acids, about 20 amino acids to about 40 amino acids, about 20 amino acids to about 35 amino acids, about 20 amino acids to about 30 amino acids, about 20 amino acids to about 25 amino acids, about 25 amino acids to about 1000 amino acids, about 25 amino acids to about 950 amino acids, about 25 amino acids to about 900 amino acids, about 25 amino acids to about 850 amino acids, about 25 amino acids to about 800 amino acids, about 25 amino acids to about 750 amino acids, about 25 amino acids to about 700 amino acids, about 25 amino acids to about 650 amino acids, about 25 amino acids to about 600 amino acids, about 25 amino acids to about 550 amino acids, about 25 amino acids to about 500 amino acids, about 25 amino acids to about 450 amino acids, about 25 amino acids to about 400 amino acids, about 25 amino acids to about 350 amino acids, about 25 amino acids to about 300 amino acids, about 25 amino acids to about 280 amino acids, about 25 amino acids to about 260 amino acids, about 25 amino acids to about 240 amino acids, about 25 amino acids to about 220 amino acids, about 25 amino acids to about 200 amino acids, about 25 amino acids to about 195 amino acids, about 25 amino acids to about 190 amino acids, about 25 amino acids to about 185 amino acids, about 25 amino acids to about 180 amino acids, about 25 amino acids to about 175 amino acids, about 25 amino acids to about 170 amino acids, about 25 amino acids to about 165 amino acids, about 25 amino acids to about 160 amino acids, about 25 amino acids to about 155 amino acids, about 25 amino acids to about 150 amino acids, about 25 amino acids to about 145 amino acids, about 25 amino acids to about 140 amino acids, about 25 amino acids to about 135 amino acids, about 25 amino acids to about 130 amino acids, about 25 amino acids to about 125 amino acids, about 25 amino acids to about 120 amino acids, about 25 amino acids to about 115 amino acids, about 25 amino acids to about 110 amino acids, about 25 amino acids to about 105 amino acids, about 25 amino acids to about 100 amino acids, about 25 amino acids to about 95 amino acids, about 25 amino acids to about 90 amino acids, about 25 amino acids to about 85 amino acids, about 25 amino acids to about 80 amino acids, about 25 amino acids to about 75 amino acids, about 25 amino acids to about 70 amino acids, about 25 amino acids to about 65 amino acids, about 25 amino acids to about 60 amino acids, about 25 amino acids to about 55 amino acids, about 25 amino acids to about 50 amino acids, about 25 amino acids to about 45 amino acids, about 25 amino acids to about 40 amino acids, about 25 amino acids to about 35 amino acids, about 25 amino acids to about 30 amino acids, about 30 amino acids to about 1000 amino acids, about 30 amino acids to about 950 amino acids, about 30 amino acids to about 900 amino acids, about 30 amino acids to about 850 amino acids, about 30 amino acids to about 800 amino acids, about 30 amino acids to about 750 amino acids, about 30 amino acids to about 700 amino acids, about 30 amino acids to about 650 amino acids, about 30 amino acids to about 600 amino acids, about 30 amino acids to about 550 amino acids, about 30 amino acids to about 500 amino acids, about 30 amino acids to about 450 amino acids, about 30 amino acids to about 400 amino acids, about 30 amino acids to about 350 amino acids, about 30 amino acids to about 300 amino acids, about 30 amino acids to about 280 amino acids, about 30 amino acids to about 260 amino acids, about 30 amino acids to about 240 amino acids, about 30 amino acids to about 220 amino acids, about 30 amino acids to about 200 amino acids, about 30 amino acids to about 195 amino acids, about 30 amino acids to about 190 amino acids, about 30 amino acids to about 185 amino acids, about 30 amino acids to about 180 amino acids, about 30 amino acids to about 175 amino acids, about 30 amino acids to about 170 amino acids, about 30 amino acids to about 165 amino acids, about 30 amino acids to about 160 amino acids, about 30 amino acids to about 155 amino acids, about 30 amino acids to about 150 amino acids, about 30 amino acids to about 145 amino acids, about 30 amino acids to about 140 amino acids, about 30 amino acids to about 135 amino acids, about 30 amino acids to about 130 amino acids, about 30 amino acids to about 125 amino acids, about 30 amino acids to about 120 amino acids, about 30 amino acids to about 115 amino acids, about 30 amino acids to about 110 amino acids, about 30 amino acids to about 105 amino acids, about 30 amino acids to about 100 amino acids, about 30 amino acids to about 95 amino acids, about 30 amino acids to about 90 amino acids, about 30 amino acids to about 85 amino acids, about 30 amino acids to about 80 amino acids, about 30 amino acids to about 75 amino acids, about 30 amino acids to about 70 amino acids, about 30 amino acids to about 65 amino acids, about 30 amino acids to about 60 amino acids, about 30 amino acids to about 55 amino acids, about 30 amino acids to about 50 amino acids, about 30 amino acids to about 45 amino acids, about 30 amino acids to about 40 amino acids, about 30 amino acids to about 35 amino acids, about 35 amino acids to about 1000 amino acids, about 35 amino acids to about 950 amino acids, about 35 amino acids to about 900 amino acids, about 35 amino acids to about 850 amino acids, about 35 amino acids to about 800 amino acids, about 35 amino acids to about 750 amino acids, about 35 amino acids to about 700 amino acids, about 35 amino acids to about 650 amino acids, about 35 amino acids to about 600 amino acids, about 35 amino acids to about 550 amino acids, about 35 amino acids to about 500 amino acids, about 35 amino acids to about 450 amino acids, about 35 amino acids to about 400 amino acids, about 35 amino acids to about 350 amino acids, about 35 amino acids to about 300 amino acids, about 35 amino acids to about 280 amino acids, about 35 amino acids to about 260 amino acids, about 35 amino acids to about 240 amino acids, about 35 amino acids to about 220 amino acids, about 35 amino acids to about 200 amino acids, about 35 amino acids to about 195 amino acids, about 35 amino acids to about 190 amino acids, about 35 amino acids to about 185 amino acids, about 35 amino acids to about 180 amino acids, about 35 amino acids to about 175 amino acids, about 35 amino acids to about 170 amino acids, about 35 amino acids to about 165 amino acids, about 35 amino acids to about 160 amino acids, about 35 amino acids to about 155 amino acids, about 35 amino acids to about 150 amino acids, about 35 amino acids to about 145 amino acids, about 35 amino acids to about 140 amino acids, about 35 amino acids to about 135 amino acids, about 35 amino acids to about 130 amino acids, about 35 amino acids to about 125 amino acids, about 35 amino acids to about 120 amino acids, about 35 amino acids to about 115 amino acids, about 35 amino acids to about 110 amino acids, about 35 amino acids to about 105 amino acids, about 35 amino acids to about 100 amino acids, about 35 amino acids to about 95 amino acids, about 35 amino acids to about 90 amino acids, about 35 amino acids to about 85 amino acids, about 35 amino acids to about 80 amino acids, about 35 amino acids to about 75 amino acids, about 35 amino acids to about 70 amino acids, about 35 amino acids to about 65 amino acids, about 35 amino acids to about 60 amino acids, about 35 amino acids to about 55 amino acids, about 35 amino acids to about 50 amino acids, about 35 amino acids to about 45 amino acids, about 35 amino acids to about 40 amino acids, about 40 amino acids to about 1000 amino acids, about 40 amino acids to about 950 amino acids, about 40 amino acids to about 900 amino acids, about 40 amino acids to about 850 amino acids, about 40 amino acids to about 800 amino acids, about 40 amino acids to about 750 amino acids, about 40 amino acids to about 700 amino acids, about 40 amino acids to about 650 amino acids, about 40 amino acids to about 600 amino acids, about 40 amino acids to about 550 amino acids, about 40 amino acids to about 500 amino acids, about 40 amino acids to about 450 amino acids, about 40 amino acids to about 400 amino acids, about 40 amino acids to about 350 amino acids, about 40 amino acids to about 300 amino acids, about 40 amino acids to about 280 amino acids, about 40 amino acids to about 260 amino acids, about 40 amino acids to about 240 amino acids, about 40 amino acids to about 220 amino acids, about 40 amino acids to about 200 amino acids, about 40 amino acids to about 195 amino acids, about 40 amino acids to about 190 amino acids, about 40 amino acids to about 185 amino acids, about 40 amino acids to about 180 amino acids, about 40 amino acids to about 175 amino acids, about 40 amino acids to about 170 amino acids, about 40 amino acids to about 165 amino acids, about 40 amino acids to about 160 amino acids, about 40 amino acids to about 155 amino acids, about 40 amino acids to about 150 amino acids, about 40 amino acids to about 145 amino acids, about 40 amino acids to about 140 amino acids, about 40 amino acids to about 135 amino acids, about 40 amino acids to about 130 amino acids, about 40 amino acids to about 125 amino acids, about 40 amino acids to about 120 amino acids, about 40 amino acids to about 115 amino acids, about 40 amino acids to about 110 amino acids, about 40 amino acids to about 105 amino acids, about 40 amino acids to about 100 amino acids, about 40 amino acids to about 95 amino acids, about 40 amino acids to about 90 amino acids, about 40 amino acids to about 85 amino acids, about 40 amino acids to about 80 amino acids, about 40 amino acids to about 75 amino acids, about 40 amino acids to about 70 amino acids, about 40 amino acids to about 65 amino acids, about 40 amino acids to about 60 amino acids, about 40 amino acids to about 55 amino acids, about 40 amino acids to about 50 amino acids, about 40 amino acids to about 45 amino acids, about 45 amino acids to about 1000 amino acids, about 45 amino acids to about 950 amino acids, about 45 amino acids to about 900 amino acids, about 45 amino acids to about 850 amino acids, about 45 amino acids to about 800 amino acids, about 45 amino acids to about 750 amino acids, about 45 amino acids to about 700 amino acids, about 45 amino acids to about 650 amino acids, about 45 amino acids to about 600 amino acids, about 45 amino acids to about 550 amino acids, about 45 amino acids to about 500 amino acids, about 45 amino acids to about 450 amino acids, about 45 amino acids to about 400 amino acids, about 45 amino acids to about 350 amino acids, about 45 amino acids to about 300 amino acids, about 45 amino acids to about 280 amino acids, about 45 amino acids to about 260 amino acids, about 45 amino acids to about 240 amino acids, about 45 amino acids to about 220 amino acids, about 45 amino acids to about 200 amino acids, about 45 amino acids to about 195 amino acids, about 45 amino acids to about 190 amino acids, about 45 amino acids to about 185 amino acids, about 45 amino acids to about 180 amino acids, about 45 amino acids to about 175 amino acids, about 45 amino acids to about 170 amino acids, about 45 amino acids to about 165 amino acids, about 45 amino acids to about 160 amino acids, about 45 amino acids to about 155 amino acids, about 45 amino acids to about 150 amino acids, about 45 amino acids to about 145 amino acids, about 45 amino acids to about 140 amino acids, about 45 amino acids to about 135 amino acids, about 45 amino acids to about 130 amino acids, about 45 amino acids to about 125 amino acids, about 45 amino acids to about 120 amino acids, about 45 amino acids to about 115 amino acids, about 45 amino acids to about 110 amino acids, about 45 amino acids to about 105 amino acids, about 45 amino acids to about 100 amino acids, about 45 amino acids to about 95 amino acids, about 45 amino acids to about 90 amino acids, about 45 amino acids to about 85 amino acids, about 45 amino acids to about 80 amino acids, about 45 amino acids to about 75 amino acids, about 45 amino acids to about 70 amino acids, about 45 amino acids to about 65 amino acids, about 45 amino acids to about 60 amino acids, about 45 amino acids to about 55 amino acids, about 45 amino acids to about 50 amino acids, about 50 amino acids to about 1000 amino acids, about 50 amino acids to about 950 amino acids, about 50 amino acids to about 900 amino acids, about 50 amino acids to about 850 amino acids, about 50 amino acids to about 800 amino acids, about 50 amino acids to about 750 amino acids, about 50 amino acids to about 700 amino acids, about 50 amino acids to about 650 amino acids, about 50 amino acids to about 600 amino acids, about 50 amino acids to about 550 amino acids, about 50 amino acids to about 500 amino acids, about 50 amino acids to about 450 amino acids, about 50 amino acids to about 400 amino acids, about 50 amino acids to about 350 amino acids, about 50 amino acids to about 300 amino acids, about 50 amino acids to about 280 amino acids, about 50 amino acids to about 260 amino acids, about 50 amino acids to about 240 amino acids, about 50 amino acids to about 220 amino acids, about 50 amino acids to about 200 amino acids, about 50 amino acids to about 195 amino acids, about 50 amino acids to about 190 amino acids, about 50 amino acids to about 185 amino acids, about 50 amino acids to about 180 amino acids, about 50 amino acids to about 175 amino acids, about 50 amino acids to about 170 amino acids, about 50 amino acids to about 165 amino acids, about 50 amino acids to about 160 amino acids, about 50 amino acids to about 155 amino acids, about 50 amino acids to about 150 amino acids, about 50 amino acids to about 145 amino acids, about 50 amino acids to about 140 amino acids, about 50 amino acids to about 135 amino acids, about 50 amino acids to about 130 amino acids, about 50 amino acids to about 125 amino acids, about 50 amino acids to about 120 amino acids, about 50 amino acids to about 115 amino acids, about 50 amino acids to about 110 amino acids, about 50 amino acids to about 105 amino acids, about 50 amino acids to about 100 amino acids, about 50 amino acids to about 95 amino acids, about 50 amino acids to about 90 amino acids, about 50 amino acids to about 85 amino acids, about 50 amino acids to about 80 amino acids, about 50 amino acids to about 75 amino acids, about 50 amino acids to about 70 amino acids, about 50 amino acids to about 65 amino acids, about 50 amino acids to about 60 amino acids, about 50 amino acids to about 55 amino acids, about 55 amino acids to about 1000 amino acids, about 55 amino acids to about 950 amino acids, about 55 amino acids to about 900 amino acids, about 55 amino acids to about 850 amino acids, about 55 amino acids to about 800 amino acids, about 55 amino acids to about 750 amino acids, about 55 amino acids to about 700 amino acids, about 55 amino acids to about 650 amino acids, about 55 amino acids to about 600 amino acids, about 55 amino acids to about 550 amino acids, about 55 amino acids to about 500 amino acids, about 55 amino acids to about 450 amino acids, about 55 amino acids to about 400 amino acids, about 55 amino acids to about 350 amino acids, about 55 amino acids to about 300 amino acids, about 55 amino acids to about 280 amino acids, about 55 amino acids to about 260 amino acids, about 55 amino acids to about 240 amino acids, about 55 amino acids to about 220 amino acids, about 55 amino acids to about 200 amino acids, about 55 amino acids to about 195 amino acids, about 55 amino acids to about 190 amino acids, about 55 amino acids to about 185 amino acids, about 55 amino acids to about 180 amino acids, about 55 amino acids to about 175 amino acids, about 55 amino acids to about 170 amino acids, about 55 amino acids to about 165 amino acids, about 55 amino acids to about 160 amino acids, about 55 amino acids to about 155 amino acids, about 55 amino acids to about 150 amino acids, about 55 amino acids to about 145 amino acids, about 55 amino acids to about 140 amino acids, about 55 amino acids to about 135 amino acids, about 55 amino acids to about 130 amino acids, about 55 amino acids to about 125 amino acids, about 55 amino acids to about 120 amino acids, about 55 amino acids to about 115 amino acids, about 55 amino acids to about 110 amino acids, about 55 amino acids to about 105 amino acids, about 55 amino acids to about 100 amino acids, about 55 amino acids to about 95 amino acids, about 55 amino acids to about 90 amino acids, about 55 amino acids to about 85 amino acids, about 55 amino acids to about 80 amino acids, about 55 amino acids to about 75 amino acids, about 55 amino acids to about 70 amino acids, about 55 amino acids to about 65 amino acids, about 55 amino acids to about 60 amino acids, about 60 amino acids to about 1000 amino acids, about 60 amino acids to about 950 amino acids, about 60 amino acids to about 900 amino acids, about 60 amino acids to about 850 amino acids, about 60 amino acids to about 800 amino acids, about 60 amino acids to about 750 amino acids, about 60 amino acids to about 700 amino acids, about 60 amino acids to about 650 amino acids, about 60 amino acids to about 600 amino acids, about 60 amino acids to about 550 amino acids, about 60 amino acids to about 500 amino acids, about 60 amino acids to about 450 amino acids, about 60 amino acids to about 400 amino acids, about 60 amino acids to about 350 amino acids, about 60 amino acids to about 300 amino acids, about 60 amino acids to about 280 amino acids, about 60 amino acids to about 260 amino acids, about 60 amino acids to about 240 amino acids, about 60 amino acids to about 220 amino acids, about 60 amino acids to about 200 amino acids, about 60 amino acids to about 195 amino acids, about 60 amino acids to about 190 amino acids, about 60 amino acids to about 185 amino acids, about 60 amino acids to about 180 amino acids, about 60 amino acids to about 175 amino acids, about 60 amino acids to about 170 amino acids, about 60 amino acids to about 165 amino acids, about 60 amino acids to about 160 amino acids, about 60 amino acids to about 155 amino acids, about 60 amino acids to about 150 amino acids, about 60 amino acids to about 145 amino acids, about 60 amino acids to about 140 amino acids, about 60 amino acids to about 135 amino acids, about 60 amino acids to about 130 amino acids, about 60 amino acids to about 125 amino acids, about 60 amino acids to about 120 amino acids, about 60 amino acids to about 115 amino acids, about 60 amino acids to about 110 amino acids, about 60 amino acids to about 105 amino acids, about 60 amino acids to about 100 amino acids, about 60 amino acids to about 95 amino acids, about 60 amino acids to about 90 amino acids, about 60 amino acids to about 85 amino acids, about 60 amino acids to about 80 amino acids, about 60 amino acids to about 75 amino acids, about 60 amino acids to about 70 amino acids, about 60 amino acids to about 65 amino acids, about 65 amino acids to about 1000 amino acids, about 65 amino acids to about 950 amino acids, about 65 amino acids to about 900 amino acids, about 65 amino acids to about 850 amino acids, about 65 amino acids to about 800 amino acids, about 65 amino acids to about 750 amino acids, about 65 amino acids to about 700 amino acids, about 65 amino acids to about 650 amino acids, about 65 amino acids to about 600 amino acids, about 65 amino acids to about 550 amino acids, about 65 amino acids to about 500 amino acids, about 65 amino acids to about 450 amino acids, about 65 amino acids to about 400 amino acids, about 65 amino acids to about 350 amino acids, about 65 amino acids to about 300 amino acids, about 65 amino acids to about 280 amino acids, about 65 amino acids to about 260 amino acids, about 65 amino acids to about 240 amino acids, about 65 amino acids to about 220 amino acids, about 65 amino acids to about 200 amino acids, about 65 amino acids to about 195 amino acids, about 65 amino acids to about 190 amino acids, about 65 amino acids to about 185 amino acids, about 65 amino acids to about 180 amino acids, about 65 amino acids to about 175 amino acids, about 65 amino acids to about 170 amino acids, about 65 amino acids to about 165 amino acids, about 65 amino acids to about 160 amino acids, about 65 amino acids to about 155 amino acids, about 65 amino acids to about 150 amino acids, about 65 amino acids to about 145 amino acids, about 65 amino acids to about 140 amino acids, about 65 amino acids to about 135 amino acids, about 65 amino acids to about 130 amino acids, about 65 amino acids to about 125 amino acids, about 65 amino acids to about 120 amino acids, about 65 amino acids to about 115 amino acids, about 65 amino acids to about 110 amino acids, about 65 amino acids to about 105 amino acids, about 65 amino acids to about 100 amino acids, about 65 amino acids to about 95 amino acids, about 65 amino acids to about 90 amino acids, about 65 amino acids to about 85 amino acids, about 65 amino acids to about 80 amino acids, about 65 amino acids to about 75 amino acids, about 65 amino acids to about 70 amino acids, about 70 amino acids to about 1000 amino acids, about 70 amino acids to about 950 amino acids, about 70 amino acids to about 900 amino acids, about 70 amino acids to about 850 amino acids, about 70 amino acids to about 800 amino acids, about 70 amino acids to about 750 amino acids, about 70 amino acids to about 700 amino acids, about 70 amino acids to about 650 amino acids, about 70 amino acids to about 600 amino acids, about 70 amino acids to about 550 amino acids, about 70 amino acids to about 500 amino acids, about 70 amino acids to about 450 amino acids, about 70 amino acids to about 400 amino acids, about 70 amino acids to about 350 amino acids, about 70 amino acids to about 300 amino acids, about 70 amino acids to about 280 amino acids, about 70 amino acids to about 260 amino acids, about 70 amino acids to about 240 amino acids, about 70 amino acids to about 220 amino acids, about 70 amino acids to about 200 amino acids, about 70 amino acids to about 195 amino acids, about 70 amino acids to about 190 amino acids, about 70 amino acids to about 185 amino acids, about 70 amino acids to about 180 amino acids, about 70 amino acids to about 175 amino acids, about 70 amino acids to about 170 amino acids, about 70 amino acids to about 165 amino acids, about 70 amino acids to about 160 amino acids, about 70 amino acids to about 155 amino acids, about 70 amino acids to about 150 amino acids, about 70 amino acids to about 145 amino acids, about 70 amino acids to about 140 amino acids, about 70 amino acids to about 135 amino acids, about 70 amino acids to about 130 amino acids, about 70 amino acids to about 125 amino acids, about 70 amino acids to about 120 amino acids, about 70 amino acids to about 115 amino acids, about 70 amino acids to about 110 amino acids, about 70 amino acids to about 105 amino acids, about 70 amino acids to about 100 amino acids, about 70 amino acids to about 95 amino acids, about 70 amino acids to about 90 amino acids, about 70 amino acids to about 85 amino acids, about 70 amino acids to about 80 amino acids, about 70 amino acids to about 75 amino acids, about 75 amino acids to about 1000 amino acids, about 75 amino acids to about 950 amino acids, about 75 amino acids to about 900 amino acids, about 75 amino acids to about 850 amino acids, about 75 amino acids to about 800 amino acids, about 75 amino acids to about 750 amino acids, about 75 amino acids to about 700 amino acids, about 75 amino acids to about 650 amino acids, about 75 amino acids to about 600 amino acids, about 75 amino acids to about 550 amino acids, about 75 amino acids to about 500 amino acids, about 75 amino acids to about 450 amino acids, about 75 amino acids to about 400 amino acids, about 75 amino acids to about 350 amino acids, about 75 amino acids to about 300 amino acids, about 75 amino acids to about 280 amino acids, about 75 amino acids to about 260 amino acids, about 75 amino acids to about 240 amino acids, about 75 amino acids to about 220 amino acids, about 75 amino acids to about 200 amino acids, about 75 amino acids to about 195 amino acids, about 75 amino acids to about 190 amino acids, about 75 amino acids to about 185 amino acids, about 75 amino acids to about 180 amino acids, about 75 amino acids to about 175 amino acids, about 75 amino acids to about 170 amino acids, about 75 amino acids to about 165 amino acids, about 75 amino acids to about 160 amino acids, about 75 amino acids to about 155 amino acids, about 75 amino acids to about 150 amino acids, about 75 amino acids to about 145 amino acids, about 75 amino acids to about 140 amino acids, about 75 amino acids to about 135 amino acids, about 75 amino acids to about 130 amino acids, about 75 amino acids to about 125 amino acids, about 75 amino acids to about 120 amino acids, about 75 amino acids to about 115 amino acids, about 75 amino acids to about 110 amino acids, about 75 amino acids to about 105 amino acids, about 75 amino acids to about 100 amino acids, about 75 amino acids to about 95 amino acids, about 75 amino acids to about 90 amino acids, about 75 amino acids to about 85 amino acids, about 75 amino acids to about 80 amino acids, about 80 amino acids to about 1000 amino acids, about 80 amino acids to about 950 amino acids, about 80 amino acids to about 900 amino acids, about 80 amino acids to about 850 amino acids, about 80 amino acids to about 800 amino acids, about 80 amino acids to about 750 amino acids, about 80 amino acids to about 700 amino acids, about 80 amino acids to about 650 amino acids, about 80 amino acids to about 600 amino acids, about 80 amino acids to about 550 amino acids, about 80 amino acids to about 500 amino acids, about 80 amino acids to about 450 amino acids, about 80 amino acids to about 400 amino acids, about 80 amino acids to about 350 amino acids, about 80 amino acids to about 300 amino acids, about 80 amino acids to about 280 amino acids, about 80 amino acids to about 260 amino acids, about 80 amino acids to about 240 amino acids, about 80 amino acids to about 220 amino acids, about 80 amino acids to about 200 amino acids, about 80 amino acids to about 195 amino acids, about 80 amino acids to about 190 amino acids, about 80 amino acids to about 185 amino acids, about 80 amino acids to about 180 amino acids, about 80 amino acids to about 175 amino acids, about 80 amino acids to about 170 amino acids, about 80 amino acids to about 165 amino acids, about 80 amino acids to about 160 amino acids, about 80 amino acids to about 155 amino acids, about 80 amino acids to about 150 amino acids, about 80 amino acids to about 145 amino acids, about 80 amino acids to about 140 amino acids, about 80 amino acids to about 135 amino acids, about 80 amino acids to about 130 amino acids, about 80 amino acids to about 125 amino acids, about 80 amino acids to about 120 amino acids, about 80 amino acids to about 115 amino acids, about 80 amino acids to about 110 amino acids, about 80 amino acids to about 105 amino acids, about 80 amino acids to about 100 amino acids, about 80 amino acids to about 95 amino acids, about 80 amino acids to about 90 amino acids, about 80 amino acids to about 85 amino acids, about 85 amino acids to about 1000 amino acids, about 85 amino acids to about 950 amino acids, about 85 amino acids to about 900 amino acids, about 85 amino acids to about 850 amino acids, about 85 amino acids to about 800 amino acids, about 85 amino acids to about 750 amino acids, about 85 amino acids to about 700 amino acids, about 85 amino acids to about 650 amino acids, about 85 amino acids to about 600 amino acids, about 85 amino acids to about 550 amino acids, about 85 amino acids to about 500 amino acids, about 85 amino acids to about 450 amino acids, about 85 amino acids to about 400 amino acids, about 85 amino acids to about 350 amino acids, about 85 amino acids to about 300 amino acids, about 85 amino acids to about 280 amino acids, about 85 amino acids to about 260 amino acids, about 85 amino acids to about 240 amino acids, about 85 amino acids to about 220 amino acids, about 85 amino acids to about 200 amino acids, about 85 amino acids to about 195 amino acids, about 85 amino acids to about 190 amino acids, about 85 amino acids to about 185 amino acids, about 85 amino acids to about 180 amino acids, about 85 amino acids to about 175 amino acids, about 85 amino acids to about 170 amino acids, about 85 amino acids to about 165 amino acids, about 85 amino acids to about 160 amino acids, about 85 amino acids to about 155 amino acids, about 85 amino acids to about 150 amino acids, about 85 amino acids to about 145 amino acids, about 85 amino acids to about 140 amino acids, about 85 amino acids to about 135 amino acids, about 85 amino acids to about 130 amino acids, about 85 amino acids to about 125 amino acids, about 85 amino acids to about 120 amino acids, about 85 amino acids to about 115 amino acids, about 85 amino acids to about 110 amino acids, about 85 amino acids to about 105 amino acids, about 85 amino acids to about 100 amino acids, about 85 amino acids to about 95 amino acids, about 85 amino acids to about 90 amino acids, about 90 amino acids to about 1000 amino acids, about 90 amino acids to about 950 amino acids, about 90 amino acids to about 900 amino acids, about 90 amino acids to about 850 amino acids, about 90 amino acids to about 800 amino acids, about 90 amino acids to about 750 amino acids, about 90 amino acids to about 700 amino acids, about 90 amino acids to about 650 amino acids, about 90 amino acids to about 600 amino acids, about 90 amino acids to about 550 amino acids, about 90 amino acids to about 500 amino acids, about 90 amino acids to about 450 amino acids, about 90 amino acids to about 400 amino acids, about 90 amino acids to about 350 amino acids, about 90 amino acids to about 300 amino acids, about 90 amino acids to about 280 amino acids, about 90 amino acids to about 260 amino acids, about 90 amino acids to about 240 amino acids, about 90 amino acids to about 220 amino acids, about 90 amino acids to about 200 amino acids, about 90 amino acids to about 195 amino acids, about 90 amino acids to about 190 amino acids, about 90 amino acids to about 185 amino acids, about 90 amino acids to about 180 amino acids, about 90 amino acids to about 175 amino acids, about 90 amino acids to about 170 amino acids, about 90 amino acids to about 165 amino acids, about 90 amino acids to about 160 amino acids, about 90 amino acids to about 155 amino acids, about 90 amino acids to about 150 amino acids, about 90 amino acids to about 145 amino acids, about 90 amino acids to about 140 amino acids, about 90 amino acids to about 135 amino acids, about 90 amino acids to about 130 amino acids, about 90 amino acids to about 125 amino acids, about 90 amino acids to about 120 amino acids, about 90 amino acids to about 115 amino acids, about 90 amino acids to about 110 amino acids, about 90 amino acids to about 105 amino acids, about 90 amino acids to about 100 amino acids, about 90 amino acids to about 95 amino acids, about 95 amino acids to about 1000 amino acids, about 95 amino acids to about 950 amino acids, about 95 amino acids to about 900 amino acids, about 95 amino acids to about 850 amino acids, about 95 amino acids to about 800 amino acids, about 95 amino acids to about 750 amino acids, about 95 amino acids to about 700 amino acids, about 95 amino acids to about 650 amino acids, about 95 amino acids to about 600 amino acids, about 95 amino acids to about 550 amino acids, about 95 amino acids to about 500 amino acids, about 95 amino acids to about 450 amino acids, about 95 amino acids to about 400 amino acids, about 95 amino acids to about 350 amino acids, about 95 amino acids to about 300 amino acids, about 95 amino acids to about 280 amino acids, about 95 amino acids to about 260 amino acids, about 95 amino acids to about 240 amino acids, about 95 amino acids to about 220 amino acids, about 95 amino acids to about 200 amino acids, about 95 amino acids to about 195 amino acids, about 95 amino acids to about 190 amino acids, about 95 amino acids to about 185 amino acids, about 95 amino acids to about 180 amino acids, about 95 amino acids to about 175 amino acids, about 95 amino acids to about 170 amino acids, about 95 amino acids to about 165 amino acids, about 95 amino acids to about 160 amino acids, about 95 amino acids to about 155 amino acids, about 95 amino acids to about 150 amino acids, about 95 amino acids to about 145 amino acids, about 95 amino acids to about 140 amino acids, about 95 amino acids to about 135 amino acids, about 95 amino acids to about 130 amino acids, about 95 amino acids to about 125 amino acids, about 95 amino acids to about 120 amino acids, about 95 amino acids to about 115 amino acids, about 95 amino acids to about 110 amino acids, about 95 amino acids to about 105 amino acids, about 95 amino acids to about 100 amino acids, about 100 amino acids to about 1000 amino acids, about 100 amino acids to about 950 amino acids, about 100 amino acids to about 900 amino acids, about 100 amino acids to about 850 amino acids, about 100 amino acids to about 800 amino acids, about 100 amino acids to about 750 amino acids, about 100 amino acids to about. 700 amino acids, about 100 amino acids to about 650 amino acids, about 100 amino acids to about 600 amino acids, about 100 amino acids to about 550 amino acids, about 100 amino acids to about 500 amino acids, about 100 amino acids to about 450 amino acids, about 100 amino acids to about 400 amino acids, about 100 amino acids to about 350 amino acids, about 100 amino acids to about 300 amino acids, about 100 amino acids to about 280 amino acids, about 100 amino acids to about 260 amino acids, about 100 amino acids to about 240 amino acids, about 100 amino acids to about 220 amino acids, about 100 amino acids to about 200 amino acids, about 100 amino acids to about 195 amino acids, about 100 amino acids to about 190 amino acids, about 100 amino acids to about 185 amino acids, about 100 amino acids to about 180 amino acids, about 100 amino acids to about 175 amino acids, about 100 amino acids to about 170 amino acids, about 100 amino acids to about 165 amino acids, about 100 amino acids to about 160 amino acids, about 100 amino acids to about 155 amino acids, about 100 amino acids to about 150 amino acids, about 100 amino acids to about 145 amino acids, about 100 amino acids to about 140 amino acids, about 100 amino acids to about 135 amino acids, about 100 amino acids to about 130 amino acids, about 100 amino acids to about 125 amino acids, about 100 amino acids to about 120 amino acids, about 100 amino acids to about 115 amino acids, about 100 amino acids to about 110 amino acids, about 100 amino acids to about 105 amino acids, about 105 amino acids to about 1000 amino acids, about 105 amino acids to about 950 amino acids, about 105 amino acids to about 900 amino acids, about 105 amino acids to about 850 amino acids, about 105 amino acids to about 800 amino acids, about 105 amino acids to about 750 amino acids, about 105 amino acids to about 700 amino acids, about 105 amino acids to about 650 amino acids, about 105 amino acids to about 600 amino acids, about 105 amino acids to about 550 amino acids, about 105 amino acids to about 500 amino acids, about 105 amino acids to about 450 amino acids, about 105 amino acids to about 400 amino acids, about 105 amino acids to about 350 amino acids, about 105 amino acids to about 300 amino acids, about 105 amino acids to about 280 amino acids, about 105 amino acids to about 260 amino acids, about 105 amino acids to about 240 amino acids, about 105 amino acids to about 220 amino acids, about 105 amino acids to about 200 amino acids, about 105 amino acids to about 195 amino acids, about 105 amino acids to about 190 amino acids, about 105 amino acids to about 185 amino acids, about 105 amino acids to about 180 amino acids, about 105 amino acids to about 175 amino acids, about 105 amino acids to about 170 amino acids, about 105 amino acids to about 165 amino acids, about 105 amino acids to about 160 amino acids, about 105 amino acids to about 155 amino acids, about 105 amino acids to about 150 amino acids, about 105 amino acids to about 145 amino acids, about 105 amino acids to about 140 amino acids, about 105 amino acids to about 135 amino acids, about 105 amino acids to about 130 amino acids, about 105 amino acids to about 125 amino acids, about 105 amino acids to about 120 amino acids, about 105 amino acids to about 115 amino acids, about 105 amino acids to about 110 amino acids, about 110 amino acids to about 1000 amino acids, about 110 amino acids to about 950 amino acids, about 110 amino acids to about 900 amino acids, about 110 amino acids to about 850 amino acids, about 110 amino acids to about 800 amino acids, about 110 amino acids to about 750 amino acids, about 110 amino acids to about 700 amino acids, about 110 amino acids to about 650 amino acids, about 110 amino acids to about 600 amino acids, about 110 amino acids to about 550 amino acids, about 110 amino acids to about 500 amino acids, about 110 amino acids to about 450 amino acids, about 110 amino acids to about 400 amino acids, about 110 amino acids to about 350 amino acids, about 110 amino acids to about 300 amino acids, about 110 amino acids to about 280 amino acids, about 110 amino acids to about 260 amino acids, about 110 amino acids to about 240 amino acids, about 110 amino acids to about 220 amino acids, about 110 amino acids to about 200 amino acids, about 110 amino acids to about 195 amino acids, about 110 amino acids to about 190 amino acids, about 110 amino acids to about 185 amino acids, about 110 amino acids to about 180 amino acids, about 110 amino acids to about 175 amino acids, about 110 amino acids to about 170 amino acids, about 110 amino acids to about 165 amino acids, about 110 amino acids to about 160 amino acids, about 110 amino acids to about 155 amino acids, about 110 amino acids to about 150 amino acids, about 110 amino acids to about 145 amino acids, about 110 amino acids to about 140 amino acids, about 110 amino acids to about 135 amino acids, about 110 amino acids to about 130 amino acids, about 110 amino acids to about 125 amino acids, about 110 amino acids to about 120 amino acids, about 110 amino acids to about 115 amino acids, about 115 amino acids to about 1000 amino acids, about 115 amino acids to about 950 amino acids, about 115 amino acids to about 900 amino acids, about 115 amino acids to about 850 amino acids, about 115 amino acids to about 800 amino acids, about 115 amino acids to about 750 amino acids, about 115 amino acids to about 700 amino acids, about 115 amino acids to about 650 amino acids, about 115 amino acids to about 600 amino acids, about 115 amino acids to about 550 amino acids, about 115 amino acids to about 500 amino acids, about 115 amino acids to about 450 amino acids, about 115 amino acids to about 400 amino acids, about 115 amino acids to about 350 amino acids, about 115 amino acids to about 300 amino acids, about 115 amino acids to about 280 amino acids, about 115 amino acids to about 260 amino acids, about 115 amino acids to about 240 amino acids, about 115 amino acids to about 220 amino acids, about 115 amino acids to about 200 amino acids, about 115 amino acids to about 195 amino acids, about 115 amino acids to about 190 amino acids, about 115 amino acids to about 185 amino acids, about 115 amino acids to about 180 amino acids, about 115 amino acids to about 175 amino acids, about 115 amino acids to about 170 amino acids, about 115 amino acids to about 165 amino acids, about 115 amino acids to about 160 amino acids, about 115 amino acids to about 155 amino acids, about 115 amino acids to about 150 amino acids, about 115 amino acids to about 145 amino acids, about 115 amino acids to about 140 amino acids, about 115 amino acids to about 135 amino acids, about 115 amino acids to about 130 amino acids, about 115 amino acids to about 125 amino acids, about 115 amino acids to about 120 amino acids, about 120 amino acids to about 1000 amino acids, about 120 amino acids to about 950 amino acids, about 120 amino acids to about 900 amino acids, about 120 amino acids to about 850 amino acids, about 120 amino acids to about 800 amino acids, about 120 amino acids to about 750 amino acids, about 120 amino acids to about 700 amino acids, about 120 amino acids to about 650 amino acids, about 120 amino acids to about 600 amino acids, about 120 amino acids to about 550 amino acids, about 120 amino acids to about 500 amino acids, about 120 amino acids to about 450 amino acids, about 120 amino acids to about 400 amino acids, about 120 amino acids to about 350 amino acids, about 120 amino acids to about 300 amino acids, about 120 amino acids to about 280 amino acids, about 120 amino acids to about 260 amino acids, about 120 amino acids to about 240 amino acids, about 120 amino acids to about 220 amino acids, about 120 amino acids to about 200 amino acids, about 120 amino acids to about 195 amino acids, about 120 amino acids to about 190 amino acids, about 120 amino acids to about 185 amino acids, about 120 amino acids to about 180 amino acids, about 120 amino acids to about 175 amino acids, about 120 amino acids to about 170 amino acids, about 120 amino acids to about 165 amino acids, about 120 amino acids to about 160 amino acids, about 120 amino acids to about 155 amino acids, about 120 amino acids to about 150 amino acids, about 120 amino acids to about 145 amino acids, about 120 amino acids to about 140 amino acids, about 120 amino acids to about 135 amino acids, about 120 amino acids to about 130 amino acids, about 120 amino acids to about 125 amino acids, about 125 amino acids to about 1000 amino acids, about 125 amino acids to about 950 amino acids, about 125 amino acids to about 900 amino acids, about 125 amino acids to about 850 amino acids, about 125 amino acids to about 800 amino acids, about 125 amino acids to about 750 amino acids, about 125 amino acids to about 700 amino acids, about 125 amino acids to about 650 amino acids, about 125 amino acids to about 600 amino acids, about 125 amino acids to about 550 amino acids, about 125 amino acids to about 500 amino acids, about 125 amino acids to about 450 amino acids, about 125 amino acids to about 400 amino acids, about 125 amino acids to about 350 amino acids, about 125 amino acids to about 300 amino acids, about 125 amino acids to about 280 amino acids, about 125 amino acids to about 260 amino acids, about 125 amino acids to about 240 amino acids, about 125 amino acids to about 220 amino acids, about 125 amino acids to about 200 amino acids, about 125 amino acids to about 195 amino acids, about 125 amino acids to about 190 amino acids, about 125 amino acids to about 185 amino acids, about 125 amino acids to about 180 amino acids, about 125 amino acids to about 175 amino acids, about 125 amino acids to about 170 amino acids, about 125 amino acids to about 165 amino acids, about 125 amino acids to about 160 amino acids, about 125 amino acids to about 155 amino acids, about 125 amino acids to about 150 amino acids, about 125 amino acids to about 145 amino acids, about 125 amino acids to about 140 amino acids, about 125 amino acids to about 135 amino acids, about 125 amino acids to about 130 amino acids, about 130 amino acids to about 1000 amino acids, about 130 amino acids to about 950 amino acids, about 130 amino acids to about 900 amino acids, about 130 amino acids to about 850 amino acids, about 130 amino acids to about 800 amino acids, about 130 amino acids to about 750 amino acids, about 130 amino acids to about 700 amino acids, about 130 amino acids to about 650 amino acids, about 130 amino acids to about 600 amino acids, about 130 amino acids to about 550 amino acids, about 130 amino acids to about 500 amino acids, about 130 amino acids to about 450 amino acids, about 130 amino acids to about 400 amino acids, about 130 amino acids to about 350 amino acids, about 130 amino acids to about 300 amino acids, about 130 amino acids to about 280 amino acids, about 130 amino acids to about 260 amino acids, about 130 amino acids to about 240 amino acids, about 130 amino acids to about 220 amino acids, about 130 amino acids to about 200 amino acids, about 130 amino acids to about 195 amino acids, about 130 amino acids to about 190 amino acids, about 130 amino acids to about 185 amino acids, about 130 amino acids to about 180 amino acids, about 130 amino acids to about 175 amino acids, about 130 amino acids to about 170 amino acids, about 130 amino acids to about 165 amino acids, about 130 amino acids to about 160 amino acids, about 130 amino acids to about 155 amino acids, about 130 amino acids to about 150 amino acids, about 130 amino acids to about 145 amino acids, about 130 amino acids to about 140 amino acids, about 130 amino acids to about 135 amino acids, about 135 amino acids to about 1000 amino acids, about 135 amino acids to about 950 amino acids, about 135 amino acids to about 900 amino acids, about 135 amino acids to about 850 amino acids, about 135 amino acids to about 800 amino acids, about 135 amino acids to about 750 amino acids, about 135 amino acids to about 700 amino acids, about 135 amino acids to about 650 amino acids, about 135 amino acids to about 600 amino acids, about 135 amino acids to about 550 amino acids, about 135 amino acids to about 500 amino acids, about 135 amino acids to about 450 amino acids, about 135 amino acids to about 400 amino acids, about 135 amino acids to about 350 amino acids, about 135 amino acids to about 300 amino acids, about 135 amino acids to about 280 amino acids, about 135 amino acids to about 260 amino acids, about 135 amino acids to about 240 amino acids, about 135 amino acids to about 220 amino acids, about 135 amino acids to about 200 amino acids, about 135 amino acids to about 195 amino acids, about 135 amino acids to about 190 amino acids, about 135 amino acids to about 185 amino acids, about 135 amino acids to about 180 amino acids, about 135 amino acids to about 175 amino acids, about 135 amino acids to about 170 amino acids, about 135 amino acids to about 165 amino acids, about 135 amino acids to about 160 amino acids, about 135 amino acids to about 155 amino acids, about 135 amino acids to about 150 amino acids, about 135 amino acids to about 145 amino acids, about 135 amino acids to about 140 amino acids, about 140 amino acids to about 1000 amino acids, about 140 amino acids to about 950 amino acids, about 140 amino acids to about 900 amino acids, about 140 amino acids to about 850 amino acids, about 140 amino acids to about 800 amino acids, about 140 amino acids to about 750 amino acids, about 140 amino acids to about 700 amino acids, about 140 amino acids to about 650 amino acids, about 140 amino acids to about 600 amino acids, about 140 amino acids to about 550 amino acids, about 140 amino acids to about 500 amino acids, about 140 amino acids to about 450 amino acids, about 140 amino acids to about 400 amino acids, about 140 amino acids to about 350 amino acids, about 140 amino acids to about 300 amino acids, about 140 amino acids to about 280 amino acids, about 140 amino acids to about 260 amino acids, about 140 amino acids to about 240 amino acids, about 140 amino acids to about 220 amino acids, about 140 amino acids to about 200 amino acids, about 140 amino acids to about 195 amino acids, about 140 amino acids to about 190 amino acids, about 140 amino acids to about 185 amino acids, about 140 amino acids to about 180 amino acids, about 140 amino acids to about 175 amino acids, about 140 amino acids to about 170 amino acids, about 140 amino acids to about 165 amino acids, about 140 amino acids to about 160 amino acids, about 140 amino acids to about 155 amino acids, about 140 amino acids to about 150 amino acids, about 140 amino acids to about 145 amino acids, about 145 amino acids to about 1000 amino acids, about 145 amino acids to about 950 amino acids, about 145 amino acids to about 900 amino acids, about 145 amino acids to about 850 amino acids, about 145 amino acids to about 800 amino acids, about 145 amino acids to about 750 amino acids, about 145 amino acids to about 700 amino acids, about 145 amino acids to about 650 amino acids, about 145 amino acids to about 600 amino acids, about 145 amino acids to about 550 amino acids, about 145 amino acids to about 500 amino acids, about 145 amino acids to about 450 amino acids, about 145 amino acids to about 400 amino acids, about 145 amino acids to about 350 amino acids, about 145 amino acids to about 300 amino acids, about 145 amino acids to about 280 amino acids, about 145 amino acids to about 260 amino acids, about 145 amino acids to about 240 amino acids, about 145 amino acids to about 220 amino acids, about 145 amino acids to about 200 amino acids, about 145 amino acids to about 195 amino acids, about 145 amino acids to about 190 amino acids, about 145 amino acids to about 185 amino acids, about 145 amino acids to about 180 amino acids, about 145 amino acids to about 175 amino acids, about 145 amino acids to about 170 amino acids, about 145 amino acids to about 165 amino acids, about 145 amino acids to about 160 amino acids, about 145 amino acids to about 155 amino acids, about 145 amino acids to about 150 amino acids, about 150 amino acids to about 1000 amino acids, about 150 amino acids to about 950 amino acids, about 150 amino acids to about 900 amino acids, about 150 amino acids to about 850 amino acids, about 150 amino acids to about 800 amino acids, about 150 amino acids to about 750 amino acids, about 150 amino acids to about 700 amino acids, about 150 amino acids to about 650 amino acids, about 150 amino acids to about 600 amino acids, about 150 amino acids to about 550 amino acids, about 150 amino acids to about 500 amino acids, about 150 amino acids to about 450 amino acids, about 150 amino acids to about 400 amino acids, about 150 amino acids to about 350 amino acids, about 150 amino acids to about 300 amino acids, about 150 amino acids to about 280 amino acids, about 150 amino acids to about 260 amino acids, about 150 amino acids to about 240 amino acids, about 150 amino acids to about 220 amino acids, about 150 amino acids to about 200 amino acids, about 150 amino acids to about 195 amino acids, about 150 amino acids to about 190 amino acids, about 150 amino acids to about 185 amino acids, about 150 amino acids to about 180 amino acids, about 150 amino acids to about 175 amino acids, about 150 amino acids to about 170 amino acids, about 150 amino acids to about 165 amino acids, about 150 amino acids to about 160 amino acids, about 150 amino acids to about 155 amino acids, about 155 amino acids to about 1000 amino acids, about 155 amino acids to about 950 amino acids, about 155 amino acids to about 900 amino acids, about 155 amino acids to about 850 amino acids, about 155 amino acids to about 800 amino acids, about 155 amino acids to about 750 amino acids, about 155 amino acids to about 700 amino acids, about 155 amino acids to about 650 amino acids, about 155 amino acids to about 600 amino acids, about 155 amino acids to about 550 amino acids, about 155 amino acids to about 500 amino acids, about 155 amino acids to about 450 amino acids, about 155 amino acids to about 400 amino acids, about 155 amino acids to about 350 amino acids, about 155 amino acids to about 300 amino acids, about 155 amino acids to about 280 amino acids, about 155 amino acids to about 260 amino acids, about 155 amino acids to about 240 amino acids, about 155 amino acids to about 220 amino acids, about 155 amino acids to about 200 amino acids, about 155 amino acids to about 195 amino acids, about 155 amino acids to about 190 amino acids, about 155 amino acids to about 185 amino acids, about 155 amino acids to about 180 amino acids, about 155 amino acids to about 175 amino acids, about 155 amino acids to about 170 amino acids, about 155 amino acids to about 165 amino acids, about 155 amino acids to about 160 amino acids, about 160 amino acids to about 1000 amino acids, about 160 amino acids to about 950 amino acids, about 160 amino acids to about 900 amino acids, about 160 amino acids to about 850 amino acids, about 160 amino acids to about 800 amino acids, about 160 amino acids to about 750 amino acids, about 160 amino acids to about 700 amino acids, about 160 amino acids to about 650 amino acids, about 160 amino acids to about 600 amino acids, about 160 amino acids to about 550 amino acids, about 160 amino acids to about 500 amino acids, about 160 amino acids to about 450 amino acids, about 160 amino acids to about 400 amino acids, about 160 amino acids to about 350 amino acids, about 160 amino acids to about 300 amino acids, about 160 amino acids to about 280 amino acids, about 160 amino acids to about 260 amino acids, about 160 amino acids to about 240 amino acids, about 160 amino acids to about 220 amino acids, about 160 amino acids to about 200 amino acids, about 160 amino acids to about 195 amino acids, about 160 amino acids to about 190 amino acids, about 160 amino acids to about 185 amino acids, about 160 amino acids to about 180 amino acids, about 160 amino acids to about 175 amino acids, about 160 amino acids to about 170 amino acids, about 160 amino acids to about 165 amino acids, about 165 amino acids to about 1000 amino acids, about 165 amino acids to about 950 amino acids, about 165 amino acids to about 900 amino acids, about 165 amino acids to about 850 amino acids, about 165 amino acids to about 800 amino acids, about 165 amino acids to about 750 amino acids, about 165 amino acids to about 700 amino acids, about 165 amino acids to about 650 amino acids, about 165 amino acids to about 600 amino acids, about 165 amino acids to about 550 amino acids, about 165 amino acids to about 500 amino acids, about 165 amino acids to about 450 amino acids, about 165 amino acids to about 400 amino acids, about 165 amino acids to about 350 amino acids, about 165 amino acids to about 300 amino acids, about 165 amino acids to about 280 amino acids, about 165 amino acids to about 260 amino acids, about 165 amino acids to about 240 amino acids, about 165 amino acids to about 220 amino acids, about 165 amino acids to about 200 amino acids, about 165 amino acids to about 195 amino acids, about 165 amino acids to about 190 amino acids, about 165 amino acids to about 185 amino acids, about 165 amino acids to about 180 amino acids, about 165 amino acids to about 175 amino acids, about 165 amino acids to about 170 amino acids, about 170 amino acids to about 1000 amino acids, about 170 amino acids to about 950 amino acids, about 170 amino acids to about 900 amino acids, about 170 amino acids to about 850 amino acids, about 170 amino acids to about 800 amino acids, about 170 amino acids to about 750 amino acids, about 170 amino acids to about 700 amino acids, about 170 amino acids to about 650 amino acids, about 170 amino acids to about 600 amino acids, about 170 amino acids to about 550 amino acids, about 170 amino acids to about 500 amino acids, about 170 amino acids to about 450 amino acids, about 170 amino acids to about 400 amino acids, about 170 amino acids to about 350 amino acids, about 170 amino acids to about 300 amino acids, about 170 amino acids to about 280 amino acids, about 170 amino acids to about 260 amino acids, about 170 amino acids to about 240 amino acids, about 170 amino acids to about 220 amino acids, about 170 amino acids to about 200 amino acids, about 170 amino acids to about 195 amino acids, about 170 amino acids to about 190 amino acids, about 170 amino acids to about 185 amino acids, about 170 amino acids to about 180 amino acids, about 170 amino acids to about 175 amino acids, about 175 amino acids to about 1000 amino acids, about 175 amino acids to about 950 amino acids, about 175 amino acids to about 900 amino acids, about 175 amino acids to about 850 amino acids, about 175 amino acids to about 800 amino acids, about 175 amino acids to about 750 amino acids, about 175 amino acids to about 700 amino acids, about 175 amino acids to about 650 amino acids, about 175 amino acids to about 600 amino acids, about 175 amino acids to about 550 amino acids, about 175 amino acids to about 500 amino acids, about 175 amino acids to about 450 amino acids, about 175 amino acids to about 400 amino acids, about 175 amino acids to about 350 amino acids, about 175 amino acids to about 300 amino acids, about 175 amino acids to about 280 amino acids, about 175 amino acids to about 260 amino acids, about 175 amino acids to about 240 amino acids, about 175 amino acids to about 220 amino acids, about 175 amino acids to about 200 amino acids, about 175 amino acids to about 195 amino acids, about 175 amino acids to about 190 amino acids, about 175 amino acids to about 185 amino acids, about 175 amino acids to about 180 amino acids, about 180 amino acids to about 1000 amino acids, about 180 amino acids to about 950 amino acids, about 180 amino acids to about 900 amino acids, about 180 amino acids to about 850 amino acids, about 180 amino acids to about 800 amino acids, about 180 amino acids to about 750 amino acids, about 180 amino acids to about 700 amino acids, about 180 amino acids to about 650 amino acids, about 180 amino acids to about 600 amino acids, about 180 amino acids to about 550 amino acids, about 180 amino acids to about 500 amino acids, about 180 amino acids to about 450 amino acids, about 180 amino acids to about 400 amino acids, about 180 amino acids to about 350 amino acids, about 180 amino acids to about 300 amino acids, about 180 amino acids to about 280 amino acids, about 180 amino acids to about 260 amino acids, about 180 amino acids to about 240 amino acids, about 180 amino acids to about 220 amino acids, about 180 amino acids to about 200 amino acids, about 180 amino acids to about 195 amino acids, about 180 amino acids to about 190 amino acids, about 180 amino acids to about 185 amino acids, about 185 amino acids to about 1000 amino acids, about 185 amino acids to about 950 amino acids, about 185 amino acids to about 900 amino acids, about 185 amino acids to about 850 amino acids, about 185 amino acids to about 800 amino acids, about 185 amino acids to about 750 amino acids, about 185 amino acids to about 700 amino acids, about 185 amino acids to about 650 amino acids, about 185 amino acids to about 600 amino acids, about 185 amino acids to about 550 amino acids, about 185 amino acids to about 500 amino acids, about 185 amino acids to about 450 amino acids, about 185 amino acids to about 400 amino acids, about 185 amino acids to about 350 amino acids, about 185 amino acids to about 300 amino acids, about 185 amino acids to about 280 amino acids, about 185 amino acids to about 260 amino acids, about 185 amino acids to about 240 amino acids, about 185 amino acids to about 220 amino acids, about 185 amino acids to about 200 amino acids, about 185 amino acids to about 195 amino acids, about 185 amino acids to about 190 amino acids, about 190 amino acids to about 1000 amino acids, about 190 amino acids to about 950 amino acids, about 190 amino acids to about 900 amino acids, about 190 amino acids to about 850 amino acids, about 190 amino acids to about 800 amino acids, about 190 amino acids to about 750 amino acids, about 190 amino acids to about 700 amino acids, about 190 amino acids to about 650 amino acids, about 190 amino acids to about 600 amino acids, about 190 amino acids to about 550 amino acids, about 190 amino acids to about 500 amino acids, about 190 amino acids to about 450 amino acids, about 190 amino acids to about 400 amino acids, about 190 amino acids to about 350 amino acids, about 190 amino acids to about 300 amino acids, about 190 amino acids to about 280 amino acids, about 190 amino acids to about 260 amino acids, about 190 amino acids to about 240 amino acids, about 190 amino acids to about 220 amino acids, about 190 amino acids to about 200 amino acids, about 190 amino acids to about 195 amino acids, about 195 amino acids to about 1000 amino acids, about 195 amino acids to about 950 amino acids, about 195 amino acids to about 900 amino acids, about 195 amino acids to about 850 amino acids, about 195 amino acids to about 800 amino acids, about 195 amino acids to about 750 amino acids, about 195 amino acids to about 700 amino acids, about 195 amino acids to about 650 amino acids, about 195 amino acids to about 600 amino acids, about 195 amino acids to about 550 amino acids, about 195 amino acids to about 500 amino acids, about 195 amino acids to about 450 amino acids, about 195 amino acids to about 400 amino acids, about 195 amino acids to about 350 amino acids, about 195 amino acids to about 300 amino acids, about 195 amino acids to about 280 amino acids, about 195 amino acids to about 260 amino acids, about 195 amino acids to about 240 amino acids, about 195 amino acids to about 220 amino acids, about 195 amino acids to about 200 amino acids, about 200 amino acids to about 1000 amino acids, about 200 amino acids to about 950 amino acids, about 200 amino acids to about 900 amino acids, about 200 amino acids to about 850 amino acids, about 200 amino acids to about 800 amino acids, about 200 amino acids to about 750 amino acids, about 200 amino acids to about 700 amino acids, about 200 amino acids to about 650 amino acids, about 200 amino acids to about 600 amino acids, about 200 amino acids to about 550 amino acids, about 200 amino acids to about 500 amino acids, about 200 amino acids to about 450 amino acids, about 200 amino acids to about 400 amino acids, about 200 amino acids to about 350 amino acids, about 200 amino acids to about 300 amino acids, about 200 amino acids to about 280 amino acids, about 200 amino acids to about 260 amino acids, about 200 amino acids to about 240 amino acids, about 200 amino acids to about 220 amino acids, about 220 amino acids to about 1000 amino acids, about 220 amino acids to about 950 amino acids, about 220 amino acids to about 900 amino acids, about 220 amino acids to about 850 amino acids, about 220 amino acids to about 800 amino acids, about 220 amino acids to about 750 amino acids, about 220 amino acids to about 700 amino acids, about 220 amino acids to about 650 amino acids, about 220 amino acids to about 600 amino acids, about 220 amino acids to about 550 amino acids, about 220 amino acids to about 500 amino acids, about 220 amino acids to about 450 amino acids, about 220 amino acids to about 400 amino acids, about 220 amino acids to about 350 amino acids, about 220 amino acids to about 300 amino acids, about 220 amino acids to about 280 amino acids, about 220 amino acids to about 260 amino acids, about 220 amino acids to about 240 amino acids, about 240 amino acids to about 1000 amino acids, about 240 amino acids to about 950 amino acids, about 240 amino acids to about 900 amino acids, about 240 amino acids to about 850 amino acids, about 240 amino acids to about 800 amino acids, about 240 amino acids to about 750 amino acids, about 240 amino acids to about 700 amino acids, about 240 amino acids to about 650 amino acids, about 240 amino acids to about 600 amino acids, about 240 amino acids to about 550 amino acids, about 240 amino acids to about 500 amino acids, about 240 amino acids to about 450 amino acids, about 240 amino acids to about 400 amino acids, about 240 amino acids to about 350 amino acids, about 240 amino acids to about 300 amino acids, about 240 amino acids to about 280 amino acids, about 240 amino acids to about 260 amino acids, about 260 amino acids to about 1000 amino acids, about 260 amino acids to about 950 amino acids, about 260 amino acids to about 900 amino acids, about 260 amino acids to about 850 amino acids, about 260 amino acids to about 800 amino acids, about 260 amino acids to about 750 amino acids, about 260 amino acids to about 700 amino acids, about 260 amino acids to about 650 amino acids, about 260 amino acids to about 600 amino acids, about 260 amino acids to about 550 amino acids, about 260 amino acids to about 500 amino acids, about 260 amino acids to about 450 amino acids, about 260 amino acids to about 400 amino acids, about 260 amino acids to about 350 amino acids, about 260 amino acids to about 300 amino acids, about 260 amino acids to about 280 amino acids, about 280 amino acids to about 1000 amino acids, about 280 amino acids to about 950 amino acids, about 280 amino acids to about 900 amino acids, about 280 amino acids to about 850 amino acids, about 280 amino acids to about 800 amino acids, about 280 amino acids to about 750 amino acids, about 280 amino acids to about 700 amino acids, about 280 amino acids to about 650 amino acids, about 280 amino acids to about 600 amino acids, about 280 amino acids to about 550 amino acids, about 280 amino acids to about 500 amino acids, about 280 amino acids to about 450 amino acids, about 280 amino acids to about 400 amino acids, about 280 amino acids to about 350 amino acids, about 280 amino acids to about 300 amino acids, about 300 amino acids to about 1000 amino acids, about 300 amino acids to about 950 amino acids, about 300 amino acids to about 900 amino acids, about 300 amino acids to about 850 amino acids, about 300 amino acids to about 800 amino acids, about 300 amino acids to about 750 amino acids, about 300 amino acids to about 700 amino acids, about 300 amino acids to about 650 amino acids, about 300 amino acids to about 600 amino acids, about 300 amino acids to about 550 amino acids, about 300 amino acids to about 500 amino acids, about 300 amino acids to about 450 amino acids, about 300 amino acids to about 400 amino acids, about 300 amino acids to about 350 amino acids, about 350 amino acids to about 1000 amino acids, about 350 amino acids to about 950 amino acids, about 350 amino acids to about 900 amino acids, about 350 amino acids to about 850 amino acids, about 350 amino acids to about 800 amino acids, about 350 amino acids to about 750 amino acids, about 350 amino acids to about 700 amino acids, about 350 amino acids to about 650 amino acids, about 350 amino acids to about 600 amino acids, about 350 amino acids to about 550 amino acids, about 350 amino acids to about 500 amino acids, about 350 amino acids to about 450 amino acids, about 350 amino acids to about 400 amino acids, about 400 amino acids to about 1000 amino acids, about 400 amino acids to about 950 amino acids, about 400 amino acids to about 900 amino acids, about 400 amino acids to about 850 amino acids, about 400 amino acids to about 800 amino acids, about 400 amino acids to about 750 amino acids, about 400 amino acids to about 700 amino acids, about 400 amino acids to about 650 amino acids, about 400 amino acids to about 600 amino acids, about 400 amino acids to about 550 amino acids, about 400 amino acids to about 500 amino acids, about 400 amino acids to about 450 amino acids, about 450 amino acids to about 1000 amino acids, about 450 amino acids to about 950 amino acids, about 450 amino acids to about 900 amino acids, about 450 amino acids to about 850 amino acids, about 450 amino acids to about 800 amino acids, about 450 amino acids to about 750 amino acids, about 450 amino acids to about 700 amino acids, about 450 amino acids to about 650 amino acids, about 450 amino acids to about 600 amino acids, about 450 amino acids to about 550 amino acids, about 450 amino acids to about 500 amino acids, about 500 amino acids to about 1000 amino acids, about 500 amino acids to about 950 amino acids, about 500 amino acids to about 900 amino acids, about 500 amino acids to about 850 amino acids, about 500 amino acids to about 800 amino acids, about 500 amino acids to about 750 amino acids, about 500 amino acids to about 700 amino acids, about 500 amino acids to about 650 amino acids, about 500 amino acids to about 600 amino acids, about 500 amino acids to about 550 amino acids, about 550 amino acids to about 1000 amino acids, about 550 amino acids to about 950 amino acids, about 550 amino acids to about 900 amino acids, about 550 amino acids to about 850 amino acids, about 550 amino acids to about 800 amino acids, about 550 amino acids to about 750 amino acids, about 550 amino acids to about 700 amino acids, about 550 amino acids to about 650 amino acids, about 550 amino acids to about 600 amino acids, about 600 amino acids to about 1000 amino acids, about 600 amino acids to about 950 amino acids, about 600 amino acids to about 900 amino acids, about 600 amino acids to about 850 amino acids, about 600 amino acids to about 800 amino acids, about 600 amino acids to about 750 amino acids, about 600 amino acids to about 700 amino acids, about 600 amino acids to about 650 amino acids, about 650 amino acids to about 1000 amino acids, about 650 amino acids to about 950 amino acids, about 650 amino acids to about 900 amino acids, about 650 amino acids to about 850 amino acids, about 650 amino acids to about 800 amino acids, about 650 amino acids to about 750 amino acids, about 650 amino acids to about 700 amino acids, about 700 amino acids to about 1000 amino acids, about 700 amino acids to about 950 amino acids, about 700 amino acids to about 900 amino acids, about 700 amino acids to about 850 amino acids, about 700 amino acids to about 800 amino acids, about 700 amino acids to about 750 amino acids, about 750 amino acids to about 1000 amino acids, about 750 amino acids to about 950 amino acids, about 750 amino acids to about 900 amino acids, about 750 amino acids to about 850 amino acids, about 750 amino acids to about 800 amino acids, about 800 amino acids to about 1000 amino acids, about 800 amino acids to about 950 amino acids, about 800 amino acids to about 900 amino acids, about 800 amino acids to about 850 amino acids, about 850 amino acids to about 1000 amino acids, about 850 amino acids to about 950 amino acids, about 850 amino acids to about 900 amino acids, about 900 amino acids to about 1000 amino acids, about 900 amino acids to about 950 amino acids, or about 950 amino acids to about 1000 amino acids.

Any of the target-binding domains described herein can bind to its target with a dissociation equilibrium constant ($K_D$) of less than $1\times10^{-7}$ M, less than $1\times10^{-8}$ M, less than $1\times10^{-9}$ M, less than $1\times10^{-10}$ M, less than $1\times10^{-11}$ M, less than $1\times10^{-12}$ M, or less than $1\times10^{-13}$ M. In some embodiments, the antigen-binding protein construct provided herein can bind to an identifying antigen with a $K_D$ of about $1\times10^{-3}$ M to about $1\times10^{-5}$ M, about $1\times10^{-4}$ M to about $1\times10^{-6}$ M, about $1\times10^{-5}$ M to about $1\times10^{-7}$ M, about $1\times10^{-6}$ M to about $1\times10^{-8}$ M, about $1\times10^{-7}$ M to about $1\times10^{-9}$ M, about $1\times10^{-8}$ M to about $1\times10^{-10}$ M, or about $1\times10^{-9}$ M to about $1\times10^{-11}$ M (inclusive).

Any of the target-binding domains described herein can bind to its target with a $K_D$ of between about 1 pM to about 30 nM (e.g., about 1 pM to about 25 nM, about 1 pM to about 20 nM, about 1 pM to about 15 nM, about 1 pM to about 10 nM, about 1 pM to about 5 nM, about 1 pM to about 2 nM, about 1 pM to about 1 nM, about 1 pM to about 950 pM, about 1 pM to about 900 pM, about 1 pM to about 850 pM, about 1 pM to about 800 pM, about 1 pM to about 750 pM, about 1 pM to about 700 pM, about 1 pM to about 650 pM, about 1 pM to about 600 pM, about 1 pM to about 550 pM, about 1 pM to about 500 pM, about 1 pM to about 450 pM, about 1 pM to about 400 pM, about 1 pM to about 350 pM, about 1 pM to about 300 pM, about 1 pM to about 250 pM, about 1 pM to about 200 pM, about 1 pM to about 150 pM, about 1 pM to about 100 pM, about 1 pM to about 90 pM, about 1 pM to about 80 pM, about 1 pM to about 70 pM, about 1 pM to about 60 pM, about 1 pM to about 50 pM, about 1 pM to about 40 pM, about 1 pM to about 30 pM, about 1 pM to about 20 pM, about 1 pM to about 10 pM, about 1 pM to about 5 pM, about 1 pM to about 4 pM, about 1 pM to about 3 pM, about 1 pM to about 2 pM, about 2 pM to about 30 nM, about 2 pM to about 25 nM, about 2 pM to about 20 nM, about 2 pM to about 15 nM, about 2 pM to about 10 nM, about 2 pM to about 5 nM, about 2 pM to about 2 nM, about 2 pM to about 1 nM, about 2 pM to about 950 pM, about 2 pM to about 900 pM, about 2 pM to about 850 pM, about 2 pM to about 800 pM, about 2 pM to about 750 pM, about 2 pM to about 700 pM, about 2 pM to about 650 pM, about 2 pM to about 600 pM, about 2 pM to about 550 pM, about 2 pM to about 500 pM, about 2 pM to about 450 pM, about 2 pM to about 400 pM, about 2 pM to about 350 pM, about 2 pM to about 300 pM, about 2 pM to about 250 pM, about 2 pM to about 200 pM, about 2 pM to about 150 pM, about 2 pM to about 100 pM, about 2 pM to about 90 pM, about 2 pM to about 80 pM, about 2 pM to about 70 pM, about 2 pM to about 60 pM, about 2 pM to about 50 pM, about 2 pM to about 40 pM, about 2 pM to about 30 pM, about 2 pM to about 20 pM, about 2 pM to about 10 pM, about 2 pM to about 5 pM, about 2 pM to about 4 pM, about 2 pM to about 3 pM, about 5 pM to about 30 nM, about 5 pM to about 25 nM, about 5 pM to about 20 nM, about 5 pM to about 15 nM, about 5 pM to about 10 nM, about 5 pM to about 5 nM, about 5 pM to about 2 nM, about 5 pM to about 1 nM, about 5 pM to about 950 pM, about 5 pM to about 900 pM, about 5 pM to about 850 pM, about 5 pM to about 800 pM, about 5 pM to about 750 pM, about 5 pM to about 700 pM, about 5 pM to about 650 pM, about 5 pM to about 600 pM, about 5 pM to about 550 pM, about 5 pM to about 500 pM, about 5 pM to about 450 pM, about 5 pM to about 400 pM, about 5 pM to about 350 pM, about 5 pM to about 300 pM, about 5 pM to about 250 pM, about 5 pM to about 200 pM, about 5 pM to about 150 pM, about 5 pM to about 100 pM, about 5 pM to about 90 pM, about 5 pM to about 80 pM, about 5 pM to about 70 pM, about 5 pM to about 60 pM, about 5 pM to about 50 pM, about 5 pM to about 40 pM, about 5 pM to about 30 pM, about 5 pM to about 20 pM, about 5 pM to about 10 pM, about 10 pM to about 30 nM, about 10 pM to about 25 nM, about 10 pM to about 20 nM, about 10 pM to about 15 nM, about 10 pM to about 10 nM, about 10 pM to about 5 nM, about 10 pM to about 2 nM, about 10 pM to about 1 nM, about 10 pM to about 950 pM, about 10 pM to about 900 pM, about 10 pM to about 850 pM, about 10 pM to about 800 pM, about 10 pM to about 750 pM, about 10 pM to about 700 pM, about 10 pM to about 650 pM, about 10 pM to about 600 pM, about 10 pM to about 550 pM, about 10 pM to about 500 pM, about 10 pM to about 450 pM, about 10 pM to about 400 pM, about 10 pM to about 350 pM, about 10 pM to about 300 pM, about 10 pM to about 250 pM, about 10 pM to about 200 pM, about 10 pM to about 150 pM, about 10 pM to about 100 pM, about 10 pM to about 90 pM, about 10 pM to about 80 pM, about 10 pM to about 70 pM, about 10 pM to about 60 pM, about 10 pM to about 50 pM, about 10 pM to about 40 pM, about 10 pM to about 30 pM, about 10 pM to about 20 pM, about 15 pM to about 30 nM, about 15 pM to about 25 nM, about 15 pM to about 20 nM, about 15 pM to about 15 nM, about 15 pM to about 10 nM, about 15 pM to about 5 nM, about 15 pM to about 2 nM, about 15 pM to about 1 nM, about 15 pM to about 950 pM, about 15 pM to about 900 pM, about 15 pM to about 850 pM, about 15 pM to about 800 pM, about 15 pM to about 750 pM, about 15 pM to about 700 pM, about 15 pM to about 650 pM, about 15 pM to about 600 pM, about 15 pM to about 550 pM, about 15 pM to about 500 pM, about 15 pM to about 450 pM, about 15 pM to about 400 pM, about 15 pM to about 350 pM, about 15 pM to about 300 pM, about 15 pM to about 250 pM, about 15 pM to about 200 pM, about 15 pM to about 150 pM, about 15 pM to about 100 pM, about 15 pM to about 90 pM, about 15 pM to about 80 pM, about 15 pM to about 70 pM, about 15 pM to about 60 pM, about 15 pM to about 50 pM, about 15 pM to about 40 pM, about 15 pM to about 30 pM, about 15 pM to about 20 pM, about 20 pM to about 30 nM, about 20 pM to about 25 nM, about 20 pM to about 20 nM, about 20 pM to about 15 nM, about 20 pM to about 10 nM, about 20 pM to about 5 nM, about 20 pM to about 2 nM, about 20 pM to about 1 nM, about 20 pM to about 950 pM, about 20 pM to about 900 pM, about 20 pM to about 850 pM, about 20 pM to about 800 pM, about 20 pM to about 750 pM, about 20 pM to about 700 pM, about 20 pM to about 650 pM, about 20 pM to about 600 pM, about 20 pM to about 550 pM, about 20 pM to about 500 pM, about 20 pM to about 450 pM, about 20 pM to about 400 pM, about 20 pM to about 350 pM, about 20 pM to about 300 pM, about 20 pM to about 250 pM, about 20 pM to about 20 pM, about 200 pM to about 150 pM, about 20 pM to about 100 pM, about 20 pM to about 90 pM, about 20 pM to about 80 pM, about 20 pM to about 70 pM, about 20 pM to about 60 pM, about 20 pM to about 50 pM, about 20 pM to about 40 pM, about 20 pM to about 30 pM, about 30 pM to about 30 nM, about 30 pM to about 25 nM, about 30 pM to about 30 nM, about 30 pM to about 15 nM, about 30 pM to about 10 nM, about 30 pM to about 5 nM, about 30 pM to about 2 nM, about 30 pM to about 1 nM, about 30 pM to about 950 pM, about 30 pM to about 900 pM, about 30 pM to about 850 pM, about 30 pM to about 800 pM, about 30 pM to about 750 pM, about 30 pM to about 700 pM, about 30 pM to about 650 pM, about 30 pM to about 600 pM, about 30 pM to about 550 pM, about 30 pM to about 500 pM, about 30 pM to about 450 pM, about 30 pM to about 400 pM, about 30 pM to about 350 pM, about 30 pM to about 300 pM, about 30 pM to about 250 pM, about 30 pM to about 200 pM, about 30 pM to about 150 pM, about 30 pM to about 100 pM, about 30 pM to about 90 pM, about 30 pM to about 80 pM, about 30 pM to about 70 pM, about 30 pM to about 60 pM, about 30 pM to about 50 pM, about 30 pM to about 40 pM, about 40 pM to about 30 nM, about 40 pM to about 25 nM, about 40 pM to about 30 nM, about 40 pM to about 15 nM, about 40 pM to about 10 nM, about 40 pM to about 5 nM, about 40 pM to about 2 nM, about 40 pM to about 1 nM, about 40 pM to about 950 pM, about 40 pM to about 900 pM, about 40 pM to about 850 pM, about 40 pM to about 800 pM, about 40 pM to about 750 pM, about 40 pM to about 700 pM, about 40 pM to about 650 pM, about 40 pM to about 600 pM, about 40 pM to about 550 pM, about 40 pM to about 500 pM, about 40 pM to about 450 pM, about 40 pM to about 400 pM, about 40 pM to about 350 pM, about 40 pM to about 300 pM, about 40 pM to about 250 pM, about 40 pM to about 200 pM, about 40 pM to about 150 pM, about 40 pM to about 100 pM, about 40 pM to about 90 pM, about 40 pM to about 80 pM, about 40 pM to about 70 pM, about 40 pM to about 60 pM, about 40 pM to about 50 pM, about 50 pM to about 30 nM, about 50 pM to about 25 nM, about 50 pM to about 30 nM, about 50 pM to about 15 nM, about 50 pM to about 10 nM, about 50 pM to about 5 nM, about 50 pM to about 2 nM, about 50 pM to about 1 nM, about 50 pM to about 950 pM, about 50 pM to about 900 pM, about 50 pM to about 850 pM, about 50 pM to about 800 pM, about 50 pM to about 750 pM, about 50 pM to about 700 pM, about 50 pM to about 650 pM, about 50 pM to about 600 pM, about 50 pM to about 550 pM, about 50 pM to about 500 pM, about 50 pM to about 450 pM, about 50 pM to about 400 pM, about 50 pM to about 350 pM, about 50 pM to about 300 pM, about 50 pM to about 250 pM, about 50 pM to about 200 pM, about 50 pM to about 150 pM, about 50 pM to about 100 pM, about 50 pM to about 90 pM, about 50 pM to about 80 pM, about 50 pM to about 70 pM, about 50 pM to about 60 pM, about 60 pM to about 30 nM, about 60 pM to about 25 nM, about 60 pM to about 30 nM, about 60 pM to about 15 nM, about 60 pM to about 10 nM, about 60 pM to about 5 nM, about 60 pM to about 2 nM, about 60 pM to about 1 nM, about 60 pM to about 950 pM, about 60 pM to about 900 pM, about 60 pM to about 850 pM, about 60 pM to about 800 pM, about 60 pM to about 750 pM, about 60 pM to about 700 pM, about 60 pM to about 650 pM, about 60 pM to about 600 pM, about 60 pM to about 550 pM, about 60 pM to about 500 pM, about 60 pM to about 450 pM, about 60 pM to about 400 pM, about 60 pM to about 350 pM, about 60 pM to about 300 pM, about 60 pM to about 250 pM, about 60 pM to about 200 pM, about 60 pM to about 150 pM, about 60 pM to about 100 pM, about 60 pM to about 90 pM, about 60 pM to about 80 pM, about 60 pM to about 70 pM, about 70 pM to about 30 nM, about 70 pM to about 25 nM, about 70 pM to about 30 nM, about 70 pM to about 15 nM, about 70 pM to about 10 nM, about 70 pM to about 5 nM, about 70 pM to about 2 nM, about 70 pM to about 1 nM, about 70 pM to about 950 pM, about 70 pM to about 900 pM, about 70 pM to about 850 pM, about 70 pM to about 800 pM, about 70 pM to about 750 pM, about 70 pM to about 700 pM, about 70 pM to about 650 pM, about 70 pM to about 600 pM, about 70 pM to about 550 pM, about 70 pM to about 500 pM, about 70 pM to about 450 pM, about 70 pM to about 400 pM, about 70 pM to about 350 pM, about 70 pM to about 300 pM, about 70 pM to about 250 pM, about 70 pM to about 200 pM, about 70 pM to about 150 pM, about 70 pM to about 100 pM, about 70 pM to about 90 pM, about 70 pM to about 80 pM, about 80 pM to about 30 nM, about 80 pM to about 25 nM, about 80 pM to about 30 nM, about 80 pM to about 15 nM, about 80 pM to about 10 nM, about 80 pM to about 5 nM, about 80 pM to about 2 nM, about 80 pM to about 1 nM, about 80 pM to about 950 pM, about 80 pM to about 900 pM, about 80 pM to about 850 pM, about 80 pM to about 800 pM, about 80 pM to about 750 pM, about 80 pM to about 700 pM, about 80 pM to about 650 pM, about 80 pM to about 600 pM, about 80 pM to about 550 pM, about 80 pM to about 500 pM, about 80 pM to about 450 pM, about 80 pM to about 400 pM, about 80 pM to about 350 pM, about 80 pM to about 300 pM, about 80 pM to about 250 pM, about 80 pM to about 200 pM, about 80 pM to about 150 pM, about 80 pM to about 100 pM, about 80 pM to about 90 pM, about 90 pM to about 30 nM, about 90 pM to about 25 nM, about 90 pM to about 30 nM, about 90 pM to about 15 nM, about 90 pM to about 10 nM, about 90 pM to about 5 nM, about 90 pM to about 2 nM, about 90 pM to about 1 nM, about 90 pM to about 950 pM, about 90 pM to about 900 pM, about 90 pM to about 850 pM, about 90 pM to about 800 pM, about 90 pM to about 750 pM, about 90 pM to about 700 pM, about 90 pM to about 650 pM, about 90 pM to about 600 pM, about 90 pM to about 550 pM, about 90 pM to about 500 pM, about 90 pM to about 450 pM, about 90 pM to about 400 pM, about 90 pM to about 350 pM, about 90 pM to about 300 pM, about 90 pM to about 250 pM, about 90 pM to about 200 pM, about 90 pM to about 150 pM, about 90 pM to about 100 pM, about 100 pM to about 30 nM, about 100 pM to about 25 nM, about 100 pM to about 30 nM, about 100 pM to about 15 nM, about 100 pM to about 10 nM, about 100 pM to about 5 nM, about 100 pM to about 2 nM, about 100 pM to about 1 nM, about 100 pM to about 950 pM, about 100 pM to about 900 pM, about 100 pM to about 850 pM, about 100 pM to about 800 pM, about 100 pM to about 750 pM, about 100 pM to about 700 pM, about 100 pM to about 650 pM, about 100 pM to about 600 pM, about 100 pM to about 550 pM, about 100 pM to about 500 pM, about 100 pM to about 450 pM, about 100 pM to about 400 pM, about 100 pM to about 350 pM, about 100 pM to about 300 pM, about 100 pM to about 250 pM, about 100 pM to about 200 pM, about 100 pM to about 150 pM, about 150 pM to about 30 nM, about 150 pM to about 25 nM, about 150 pM to about 30 nM, about 150 pM to about 15 nM, about 150 pM to about 10 nM, about 150 pM to about 5 nM, about 150 pM to about 2 nM, about 150 pM to about 1 nM, about 150 pM to about 950 pM, about 150 pM to about 900 pM, about 150 pM to about 850 pM, about 150 pM to about 800 pM, about 150 pM to about 750 pM, about 150 pM to about 700 pM, about 150 pM to about 650 pM, about 150 pM to about 600 pM, about 150 pM to about 550 pM, about 150 pM to about 500 pM, about 150 pM to about 450 pM, about 150 pM to about 400 pM, about 150 pM to about 350 pM, about 150 pM to about 300 pM, about 150 pM to about 250 pM, about 150 pM to about 200 pM, about 200 pM to about 30 nM, about 200 pM to about 25 nM, about 200 pM to about 30 nM, about 200 pM to about 15 nM, about 200 pM to about 10 nM, about 200 pM to about 5 nM, about 200 pM to about 2 nM, about 200 pM to about 1 nM, about 200 pM to about 950 pM, about 200 pM to about 900 pM, about 200 pM to about 850 pM, about 200 pM to about 800 pM, about 200 pM to about 750 pM, about 200 pM to about 700 pM, about 200 pM to about 650 pM, about 200 pM to about 600 pM, about 200 pM to about 550 pM, about 200 pM to about 500 pM, about 200 pM to about 450 pM, about 200 pM to about 400 pM, about 200 pM to about 350 pM, about 200 pM to about 300 pM, about 200 pM to about 250 pM, about 300 pM to about 30 nM, about 300 pM to about 25 nM, about 300 pM to about 30 nM, about 300 pM to about 15 nM, about 300 pM to about 10 nM, about 300 pM to about 5 nM, about 300 pM to about 2 nM, about 300 pM to about 1 nM, about 300 pM to about 950 pM, about 300 pM to about 900 pM, about 300 pM to about 850 pM, about 300 pM to about 800 pM, about 300 pM to about 750 pM, about 300 pM to about 700 pM, about 300 pM to about 650 pM, about 300 pM to about 600 pM, about 300 pM to about 550 pM, about 300 pM to about 500 pM, about 300 pM to about 450 pM, about 300 pM to about 400 pM, about 300 pM to about 350 pM, about 400 pM to about 30 nM, about 400 pM to about 25 nM, about 400 pM to about 30 nM, about 400 pM to about 15 nM, about 400 pM to about 10 nM, about 400 pM to about 5 nM, about 400 pM to about 2 nM, about 400 pM to about 1 nM, about 400 pM to about 950 pM, about 400 pM to about 900 pM, about 400 pM to about 850 pM, about 400 pM to about 800 pM, about 400 pM to about 750 pM, about 400 pM to about 700 pM, about 400 pM to about 650 pM, about 400 pM to about 600 pM, about 400 pM to about 550 pM, about 400 pM to about 500 pM, about 500 pM to about 30 nM, about 500 pM to about 25 nM, about 500 pM to about 30 nM, about 500 pM to about 15 nM, about 500 pM to about 10 nM, about 500 pM to about 5 nM, about 500 pM to about 2 nM, about 500 pM to about 1 nM, about 500 pM to about 950 pM, about 500 pM to about 900 pM, about 500 pM to about 850 pM, about 500 pM to about 800 pM, about 500 pM to about 750 pM, about 500 pM to about 700 pM, about 500 pM to about 650 pM, about 500 pM to about 600 pM, about 500 pM to about 550 pM, about 600 pM to about 30 nM, about 600 pM to about 25 nM, about 600 pM to about 30 nM, about 600 pM to about 15 nM, about 600 pM to about 10 nM, about 600 pM to about 5 nM, about 600 pM to about 2 nM, about 600 pM to about 1 nM, about 600 pM to about 950 pM, about 600 pM to about 900 pM, about 600 pM to about 850 pM, about 600 pM to about 800 pM, about 600 pM to about 750 pM, about 600 pM to about 700 pM, about 600 pM to about 650 pM, about 700 pM to about 30 nM, about 700 pM to about 25 nM, about 700 pM to about 30 nM, about 700 pM to about 15 nM, about 700 pM to about 10 nM, about 700 pM to about 5 nM, about 700 pM to about 2 nM, about 700 pM to about 1 nM, about 700 pM to about 950 pM, about 700 pM to about 900 pM, about 700 pM to about 850 pM, about 700 pM to about 800 pM, about 700 pM to about 750 pM, about 800 pM to about 30 nM, about 800 pM to about 25 nM, about 800 pM to about 30 nM, about 800 pM to about 15 nM, about 800 pM to about 10 nM, about 800 pM to about 5 nM, about 800 pM to about 2 nM, about 800 pM to about 1 nM, about 800 pM to about 950 pM, about 800 pM to about 900 pM, about 800 pM to about 850 pM, about 900 pM to about 30 nM, about 900 pM to about 25 nM, about 900 pM to about 30 nM, about 900 pM to about 15 nM, about 900 pM to about 10 nM, about 900 pM to about 5 nM, about 900 pM to about 2 nM, about 900 pM to about 1 nM, about 900 pM to about 950 pM, about 1 nM to about 30 nM, about 1 nM to about 25 nM, about 1 nM to about 20 nM, about 1 nM to about 15 nM, about 1 nM to about 10 nM, about 1 nM to about 5 nM, about 2 nM to about 30 nM, about 2 nM to about 25 nM, about 2 nM to about 20 nM, about 2 nM to about 15 nM, about 2 nM to about 10 nM, about 2 nM to about 5 nM, about 4 nM to about 30 nM, about 4 nM to about 25 nM, about 4 nM to about 20 nM, about 4 nM to about 15 nM, about 4 nM to about 10 nM, about 4 nM to about 5 nM, about 5 nM to about 30 nM, about 5 nM to about 25 nM, about 5 nM to about 20 nM, about 5 nM to about 15 nM, about 5 nM to about 10 nM, about 10 nM to about 30 nM, about 10 nM to about 25 nM, about 10 nM to about 20 nM, about 10 nM to about 15 nM, about 15 nM to about 30 nM, about 15 nM to about 25 nM, about 15 nM to about 20 nM, about 20 nM to about 30 nM, and about 20 nM to about 25 nM).

Any of the target-binding domains described herein can bind to its target with a $K_D$ of between about 1 nM to about 10 nM (e.g., about 1 nM to about 9 nM, about 1 nM to about 8 nM, about 1 nM to about 7 nM, about 1 nM to about 6 nM, about 1 nM to about 5 nM, about 1 nM to about 4 nM, about 1 nM to about 3 nM, about 1 nM to about 2 nM, about 2 nM to about 10 nM, about 2 nM to about 9 nM, about 2 nM to about 8 nM, about 2 nM to about 7 nM, about 2 nM to about 6 nM, about 2 nM to about 5 nM, about 2 nM to about 4 nM, about 2 nM to about 3 nM, about 3 nM to about 10 nM, about 3 nM to about 9 nM, about 3 nM to about 8 nM, about 3 nM to about 7 nM, about 3 nM to about 6 nM, about 3 nM to about 5 nM, about 3 nM to about 4 nM, about 4 nM to about 10 nM, about 4 nM to about 9 nM, about 4 nM to about 8 nM, about 4 nM to about 7 nM, about 4 nM to about 6 nM, about 4 nM to about 5 nM, about 5 nM to about 10 nM, about 5 nM to about 9 nM, about 5 nM to about 8 nM, about 5 nM to about 7 nM, about 5 nM to about 6 nM, about 6 nM to about 10 nM, about 6 nM to about 9 nM, about 6 nM to about 8 nM, about 6 nM to about 7 nM, about 7 nM to about 10 nM, about 7 nM to about 9 nM, about 7 nM to about 8 nM, about 8 nM to about 10 nM, about 8 nM to about 9 nM, and about 9 nM to about 10 nM).

A variety of different methods known in the art can be used to determine the $K_D$ values of any of the antigen-binding protein constructs described herein (e.g., an electrophoretic mobility shift assay, a filter binding assay, surface plasmon resonance, and a biomolecular binding kinetics assay, etc.).

Antigen-Binding Domains

In some embodiments of any of the single-chain or multi-chain chimeric polypeptides described herein, the first target-binding domain and the second target-binding domain bind specifically to the same antigen. In some embodiments of these single-chain or multi-chain chimeric polypeptides, the first target-binding domain and the second target-binding domain bind specifically to the same epitope. In some embodiments of these single-chain or multi-chain chimeric polypeptides, the first target-binding domain and the second target-binding domain include the same amino acid sequence.

In some embodiments of any of the single-chain or multi-chain chimeric polypeptides described herein, the first target-binding domain and the second target-binding domain bind specifically to different antigens.

In some embodiments of any of the single-chain or multi-chain chimeric polypeptides described herein, one or both of the first target-binding domain and the second target-binding domain is an antigen-binding domain. In some embodiments of any of the single-chain or multi-chain chimeric polypeptides described herein, the first target-binding domain and the second target-binding domain are each antigen-binding domains. In some embodiments of any of the single-chain or multi-chain chimeric polypeptides described herein, the antigen-binding domain includes or is a scFv or a single domain antibody (e.g., a $V_{aH}H$ or a $V_{NAR}$ domain).

In some examples, an antigen-binding domain (e.g., any of the antigen-binding domains described herein) can bind specifically to any one of CD16a (see, e.g., those described in U.S. Pat. No. 9,035,026), CD28 (see, e.g., those described in U.S. Pat. No. 7,723,482), CD3 (see, e.g., those described in U.S. Pat. No. 9,226,962), CD33 (see, e.g., those described in U.S. Pat. No. 8,759,494), CD20 (see, e.g., those described in WO 2014/026054), CD19 (see, e.g., those described in U.S. Pat. No. 9,701,758), CD22 (see, e.g., those described in WO 2003/104425), CD123 (see, e.g., those described in WO 2014/130635), IL-1R (see, e.g., those described in U.S. Pat. No. 8,741,604), IL-1 (see, e.g., those described in WO 2014/095808), VEGF (see, e.g., those described in U.S. Pat. No. 9,090,684), IL-6R (see, e.g., those described in U.S. Pat. No. 7,482,436), IL-4 (see, e.g., those described in U.S. Patent Application Publication No. 2012/0171197), IL-10 (see, e.g., those described in U.S. Patent Application Publication No. 2016/0340413), PDL-1 (see, e.g., those described in Drees et al., *Protein Express. Purif.* 94:60-66, 2014), TIGIT (see, e.g., those described in U.S. Patent Application Publication No. 2017/0198042), PD-1 (see, e.g., those described in U.S. Pat. No. 7,488,802), TIM3 (see, e.g., those described in U.S. Pat. No. 8,552,156), CTLA4 (see, e.g., those described in WO 2012/120125), MICA (see, e.g., those described in WO 2016/154585), MICB (see, e.g., those described in U.S. Pat. No. 8,753,640), IL-6 (see, e.g., those described in Gejima et al., *Human Antibodies* 11(4): 121-129, 2002), IL-8 (see, e.g., those described in U.S. Pat. No. 6,117,980), TNFα (see, e.g., those described in Geng et al., *Immunol. Res.* 62(3):377-385, 2015), CD26 (see, e.g., those described in WO 2017/189526), CD36 (see, e.g., those described in U.S. Patent Application Publication No. 2015/0259429), ULBP2 (see, e.g., those described in U.S. Pat. No. 9,273,136), CD30 (see, e.g., those described in Homach et al., *Scand. J. Immunol.* 48(5):497-501, 1998), CD200 (see, e.g., those described in U.S. Pat. No. 9,085,623), IGF-1R (see, e.g., those described in U.S. Patent Application Publication No. 2017/0051063), MUC4AC (see, e.g., those described in WO 2012/170470), MUCSAC (see, e.g., those described in U.S. Pat. No. 9,238,084), Trop-2 (see, e.g., those described in WO 2013/068946), CMET (see, e.g., those described in Edwardraja et al., *Biotechnol. Bioeng.* 106(3):367-375, 2010), EGFR (see, e.g., those described in Akbari et al., *Protein Expr. Purif.* 127:8-15, 2016), HER1 (see, e.g., those described in U.S. Patent Application Publication No. 2013/0274446), HER2 (see, e.g., those described in Cao et al., *Biotechnol. Lett.* 37(7):1347-1354, 2015), HER3 (see, e.g., those described in U.S. Pat. No. 9,505,843), PSMA (see, e.g., those described in Parker et al., *Protein Expr. Purif.* 89(2):136-145, 2013), CEA (see, e.g., those described in WO 1995/015341), B7H3 (see, e.g., those described in U.S. Pat. No. 9,371,395), EPCAM (see, e.g., those described in WO 2014/159531), BCMA (see, e.g., those described in Smith et al., *Mol. Ther.* 26(6):1447-1456, 2018), P-cadherin (see, e.g., those described in U.S. Pat. No. 7,452,537), CEACAM5 (see, e.g., those described in U.S. Pat. No. 9,617,345), a UL16-binding protein (see, e.g., those described in WO 2017/083612), HLA-DR (see, e.g., Pistillo et al., *Exp. Clin. Immunogenet.* 14(2):123-130, 1997), DLL4 (see, e.g., those described in WO 2014/007513), TYRO3 (see, e.g., those described in WO 2016/166348), AXL (see, e.g., those described in WO 2012/175692), MER (see, e.g., those described in WO 2016/106221), CD122 (see, e.g., those described in U.S. Patent Application Publication No. 2016/0367664), CD155 (see, e.g., those described in WO 2017/149538), or PDGF-DD (see, e.g., those described in U.S. Pat. No. 9,441,034).

The antigen-binding domains present in any of the single-chain or multi-chain chimeric polypeptides described herein are each independently selected from the group consisting of: a VHH domain, a VNAR domain, and a scFv. In some embodiments, any of the antigen-binding domains described herein is a BiTe, a (scFv)₂, a nanobody, a nanobody-HSA, a DART, a TandAb, a scDiabody, a scDiabody-CH3, scFv-CH-CL-scFv, a HSAbody, scDiabody-HAS, or a tandem-scFv. Additional examples of antigen-binding domains that can be used in any of the single-chain or multi-chain chimeric polypeptide are known in the art.

A VHH domain is a single monomeric variable antibody domain that can be found in camelids. A VNAR domain is a single monomeric variable antibody domain that can be found in cartilaginous fish. Non-limiting aspects of VHH domains and $V_{NAR}$ domains are described in, e.g., Cromie et al., *Curr. Top. Med. Chem.* 15:2543-2557, 2016; De Genst et al., *Dev. Comp. Immunol.* 30:187-198, 2006; De Meyer et al., *Trends Biotechnol.* 32:263-270, 2014; Kijanka et al., Nanomedicine 10:161-174, 2015; Kovaleva et al., *Expert. Opin. Biol. Ther.* 14:1527-1539, 2014; Krah et al., *Immunopharmacol. Immunotoxicol.* 38:21-28, 2016; Mujic-Delic et al., *Trends Pharmacol. Sci.* 35:247-255, 2014; Muyldermans, *J. Biotechnol.* 74:277-302, 2001; Muyldermans et al., *Trends Biochem. Sci.* 26:230-235, 2001; Muyldermans, *Ann. Rev. Biochem.* 82:775-797, 2013; Rahbarizadeh et al., *Immunol. Invest.* 40:299-338, 2011; Van Audenhove et al., *EBioMedicine* 8:40-48, 2016; Van Bockstaele et al., *Curr. Opin. Investig. Drugs* 10:1212-1224, 2009; Vincke et al., *Methods Mol. Biol.* 911:15-26, 2012; and Wesolowski et al., *Med. Microbiol. Immunol.* 198:157-174, 2009.

In some embodiments, each of the antigen-binding domains in the single-chain or multi-chain chimeric polypeptides described herein are both VHH domains, or at least one antigen-binding domain is a VHH domain. In some embodiments, each of the antigen-binding domains in the single-chain or multi-chain chimeric polypeptides described herein are both VNAR domains, or at least one antigen-binding domain is a VNAR domain. In some embodiments, each of the antigen-binding domains in the single-chain or multi-chain chimeric polypeptides described herein are both scFv domains, or at least one antigen-binding domain is a scFv domain.

In some embodiments, two or more of polypeptides present in the single-chain or multi-chain chimeric polypeptide can assemble (e.g., non-covalently assemble) to form any of the antigen-binding domains described herein, e.g., an antigen-binding fragment of an antibody (e.g., any of the antigen-binding fragments of an antibody described herein), a VHH-scAb, a VHH-Fab, a Dual scFab, a F(ab')2, a diabody, a crossMab, a DAF (two-in-one), a DAF (four-in-one), a DutaMab, a DT-IgG, a knobs-in-holes common light chain, a knobs-in-holes assembly, a charge pair, a Fab-arm exchange, a SEEDbody, a LUZ-Y, a Fcab, a KX-body, an orthogonal Fab, a DVD-IgG, a IgG(H)-scFv, a scFv-(H)IgG, IgG(L)-scFv, scFv-(L)IgG, IgG(L,H)-Fv, IgG(H)-V, V(H)—IgG, IgG(L)-V, V(L)-IgG, KIH IgG-scFab, 2scFv-IgG, IgG-2scFv, scFv4-Ig, Zybody, DVI-IgG, Diabody-CH3, a triple body, a miniantibody, a minibody, a TriBi minibody, scFv-CH3 KIH, Fab-scFv, a F(ab')2-scFv2, a scFv-KIH, a Fab-scFv-Fc, a tetravalent HCAb, a scDiabody-Fc, a Diabody-Fc, a tandem scFv-Fc, an Intrabody, a dock and lock, a ImmTAC, an IgG-IgG conjugate, a Cov-X-Body, and a scFv1-PEG-scFv2. See, e.g., Spiess et al., *Mol. Immunol.* 67:95-106, 2015, incorporated in its entirety herewith, for a description of these elements. Non-limiting examples of an antigen-binding fragment of an antibody include an Fv fragment, a Fab fragment, a F(ab')$_2$ fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

An "Fv" fragment includes a non-covalently-linked dimer of one heavy chain variable domain and one light chain variable domain.

A "Fab" fragment includes, the constant domain of the light chain and the first constant domain ($C_{H1}$) of the heavy chain, in addition to the heavy and light chain variable domains of the Fv fragment.

A "F(ab')$_2$" fragment includes two Fab fragments joined, near the hinge region, by disulfide bonds.

A "dual variable domain immunoglobulin" or "DVD-Ig" refers to multivalent and multispecific binding proteins as described, e.g., in DiGiammarino et al., *Methods Mol. Biol.* 899:145-156, 2012; Jakob et al., *MABs* 5:358-363, 2013; and U.S. Pat. Nos. 7,612,181; 8,258,268; 8,586,714; 8,716,450; 8,722,855; 8,735,546; and 8,822,645, each of which is incorporated by reference in its entirety.

DARTs are described in, e.g., Garber, *Nature Reviews Drug Discovery* 13:799-801, 2014.

In some embodiments of any of the antigen-binding domains described herein can bind to an antigen selected from the group consisting of: a protein, a carbohydrate, a lipid, and a combination thereof.

Additional examples and aspects of antigen-binding domains are known in the art.

Soluble Interleukin or Cytokine Protein

In some embodiments of any of the single-chain or multi-chain chimeric polypeptides described herein, one or both of the first target-binding domain and the second target-binding domain can be a soluble interleukin protein or soluble cytokine protein. In some embodiments, the soluble interleukin or soluble cytokine protein is selected from the group of: IL-2, IL-3, IL-7, IL-8, IL-10, IL-12, IL-15, IL-17, IL-18, IL-21, PDGF-DD, and SCF. Non-limiting examples of soluble IL-2, IL-3, IL-7, IL-8, IL-10, IL-15, IL-17, IL-18, IL-21, PDGF-DD, and SCF are provided below.

```
Human Soluble IL-3
                                    (SEQ ID NO: 105)
apmtqttplkt swvncsnmid eiithlkqpp lplldfnnln gedqdilmen nlrrpnleaf nravkslqna saiesilknl lpclplataa ptrhpihikd gdwnefrrkl tfylktlena qaqqttlsla if Human Soluble IL-8
                                    (SEQ ID NO: 106)
egavlprsak elrcqcikty skpfhpkfik elrviesgph canteiivkl sdgrelcldp kenwvqrvve kflkraens Human Soluble IL-10
                                    (SEQ ID NO: 107)
spgqgtqsensc thfpgnlpnm lrdlrdafsr vktffqmkdq ldnlllkesl ledfkgylgc qalsemiqfy leevmpqaen qdpdikahvn slgenlktlr lrlrrchrfl pcenkskave qvknafnklq ekgiykamse fdifinyiea ymtmkirn Human Soluble IL-17
                                    (SEQ ID NO: 108)
gitiprn pgcpnsedkn fprtvmvnln ihnrntntnp krssdyynrs tspwnlhrne dperypsviw eakcrhlgci nadgnvdyhm nsvpiqqeil vlrrepphcp nsfrlekilv svgctcvtpi vhhva
```

-continued

Human Soluble IL-18
(SEQ ID NO: 109)
yfgklesklsvirn lndqvlfidq gnrplfedmt dsdcrdnapr tifiismykd sqprgmavti svkcekistl scenkiisfk emnppdnikd tksdiiffqr svpghdnkmq fesssyegyf lacekerdlf klilkkedel gdrsimftvq ned Human Soluble PDGF-DD
(SEQ ID NO: 110)
rdtsatpqsasi kalrnanlrr desnhltdly rrdetiqvkg ngyvqsprfp nsyprnlllt wrlhsqentr iqlvfdnqfg leeaendicr ydfvevedis etstiirgrw cghkevppri ksrtnqikit fksddyfvak pgfkiyysll edfqpaaase tnwesvtssi sgvsynspsv tdptliadal dkkiaefdtv edllkyfnpe swqedlenmy ldtpryrgrs yhdrkskvdl drlnddakry sctprnysvn ireelklanv vffprcllvq rcggncgcgt vnwrsctcns gktvkkyhev lqfepghikr rgraktmalv diqldhherc dcicssrppr Human Soluble SCF
(SEQ ID NO: 111)
egicrnrvtnnvkdv tklvanlpkd ymitlkyvpg mdvlpshcwi semvvqlsds ltdlldkfsn iseglsnysi idklvnivdd lvecvkenss kdlkksfksp eprlftpeef frifnrsida fkdfvvaset sdcvvsstls pekdsrvsvt kpfmlppvaa sslrndssss nrkaknppgd sslhwaamal palfsliigf afgalywkkr qpsltraven iqineednei smlqekeref qev Human Soluble FLT3L
(SEQ ID NO: 112)
tqdcsfqhspissd favkirelsd yllqdypvtv asnlqdeelc gglwrlvlaq rwmerlktva gskmqgller vnteihfvtk cafqpppscl rfvqtnisrl lqetseqlva lkpwitrqnf srclelqcqp dsstlpppws prpleatapt apqppllll llpvglllla aawclhwqrt rrrtprpgeq vppvpspqdl llveh Additional examples of soluble interleukin proteins and soluble cytokine proteins are known in the art.

Soluble Receptor

In some embodiments of any of the single-chain or multi-chain chimeric polypeptides described herein, one or both of the first target-binding domain and the second target-binding domain is a soluble interleukin receptor or a soluble cytokine receptor. In some embodiments, the soluble receptor is a soluble TGF-β receptor II (TGF-β RH) (see, e.g., those described in Yung et al., Am. J. Resp. Crit. Care Med. 194(9):1140-1151, 2016), a soluble TGF-βRIII (see, e.g., those described in Heng et al., Placenta 57:320, 2017), a soluble NKG2D (see, e.g., Cosman et al., Immunity 14(2):123-133, 2001; Costa et al., Front. Immunol., Vol. 9, Article 1150, May 29, 2018; doi: 10.3389/fimmu.2018.01150), a soluble NKp30 (see, e.g., Costa et al., Front. Immunol., Vol. 9, Article 1150, May 29, 2018; doi: 10.3389/fimmu.2018.01150), a soluble NKp44 (see, e.g., those described in Costa et al., Front. Immunol., Vol. 9, Article 1150, May 29, 2018; doi: 10.3389/fimmu.2018.01150), a soluble NKp46 (see, e.g., Mandelboim et al., Nature 409:1055-1060, 2001; Costa et al., Front. Immunol., Vol. 9, Article 1150, May 29, 2018; doi: 10.3389/fimmu.2018.01150), a soluble DNAM1 (see, e.g., those described in Costa et al., Front. Immunol., Vol. 9, Article 1150, May 29, 2018; doi: 10.3389/fimmu.2018.01150), a scMHCI (see, e.g., those described in Washburn et al., PLoS One 6(3); e18439, 2011), a scMHCII (see, e.g., those described in Bishwajit et al., Cellular Immunol. 170(1):25-33, 1996), a scTCR (see, e.g., those described in Weber et al., Nature 356(6372):793-796, 1992), a soluble CD155 (see, e.g., those described in Tahara-Hanaoka et al., Int. Immunol. 16(4):533-538, 2004), or a soluble CD28 (see, e.g., Hebbar et al., Clin. Exp. Immunol. 136:388-392, 2004).

Additional examples of soluble interleukin receptors and soluble cytokine receptors are known in the art.

Pairs of Affinity Domains

In some embodiments, a multi-chain chimeric polypeptide includes: 1) a first chimeric polypeptide that includes a first domain of a pair of affinity domains, and 2) a second chimeric polypeptide that includes a second domain of a pair of affinity domains such that the first chimeric polypeptide and the second chimeric polypeptide associate through the binding of the first domain and the second domain of the pair of affinity domains. In some embodiments, the pair of affinity domains is a sushi domain from an alpha chain of human IL-15 receptor (IL-15Rα) and a soluble IL-15. A sushi domain, also known as a short consensus repeat or type 1 glycoprotein motif, is a common motif in protein-protein interaction. Sushi domains have been identified on a number of protein-binding molecules, including complement components C1r, C1s, factor H, and C2m, as well as the nonimmunologic molecules factor XIII and β2-glycoprotein. A typical Sushi domain has approximately 60 amino acid residues and contains four cysteines (Ranganathan, Pac. Symp Biocomput. 2000:155-67). The first cysteine can form a disulfide bond with the third cysteine, and the second cysteine can form a disulfide bridge with the fourth cysteine. In some embodiments in which one member of the pair of affinity domains is a soluble IL-15, the soluble IL-15 has a D8N or D8A amino acid substitution. In some embodiments in which one member of the pair of affinity domains is an alpha chain of human IL-15 receptor (IL-15Rα), the human IL-15Rα is a mature full-length IL-15Rα. In some embodiments, the pair of affinity domains is barnase and barnstar. In some embodiments, the pair of affinity domains is a PKA and an AKAP. In some embodiments, the pair of affinity domains is an adapter/docking tag module based on mutated RNase I fragments (Rossi, Proc Natl Acad Sci USA. 103: 6841-6846, 2006; Sharkey et al., Cancer Res. 68:5282-5290, 2008; Rossi et al., Trends Pharmacol Sci. 33:474-481, 2012) or SNARE modules based on interactions of the proteins syntaxin, synaptotagmin, synaptobrevin, and SNAP25 (Deyev et al., Nat Biotechnol. 1486-1492, 2003).

In some embodiments, a first chimeric polypeptide of a multi-chain chimeric polypeptide includes a first domain of a pair of affinity domains and a second chimeric polypeptide of the multi-chain chimeric polypeptide includes a second domain of a pair of affinity domains, wherein the first domain of the pair of affinity domains and the second domain of the pair of affinity domains bind to each other with a dissociation equilibrium constant ($K_D$) of less than $1\times10^{-7}$ M, less than $1\times10^{-8}$ M, less than $1\times10^{-9}$ M, less than $1\times10^{-10}$ M, less than $1\times10^{-11}$ M, less than $1\times10^{-12}$ M, or less than $1\times10^{-13}$ M. In some embodiments, the first domain of the pair of affinity domains and the second domain of the pair of affinity domains bind to each other with a $K_D$ of about 1×10⁻⁴ M to about 1×10⁻⁶ M, about 1×10⁻⁵ M to about 1×10⁻⁷ M, about 1×10⁻⁶ M to about 1×10⁻⁸ M, about 1×10⁻⁷ M to about 1×10⁻⁹ M, about 1×10⁻⁸ M to about 1×10⁻¹⁰ M, about 1×10⁻⁹ M to about 1×10⁻¹¹ M, about 1×10⁻¹⁰ M to about 1×10⁻¹² M, about 1×10⁻¹¹ M to about 1×10⁻¹³ M, about 1×10⁻⁴ M to about 1×10⁻⁵ M, about 1×10⁻⁵ M to about 1×10⁻⁶ M, about 1×10⁻⁶ M to about 1×10⁻⁷ M, about 1×10⁻⁷ M to about 1×10⁻⁸ M, about 1×10⁻⁸ M to about 1×10⁻⁹ M, about 1×10⁻⁹ M to about 1×10⁻¹⁰ M, about 1×10⁻¹⁰ M to about 1×10⁻¹¹ M, about 1×10⁻¹¹ M to about 1×10⁻¹² M, or about 1×10⁻¹² M to about 1×10⁻¹³ M (inclusive). Any of a variety of different methods known in the art can be used to determine the $K_D$ value of the binding of the first domain of the pair of affinity domains and the second domain of the pair of affinity domains (e.g., an electrophoretic mobility shift assay, a filter binding assay, surface plasmon resonance, and a biomolecular binding kinetics assay, etc.).

In some embodiments, a first chimeric polypeptide of a multi-chain chimeric polypeptide includes a first domain of a pair of affinity domains and a second chimeric polypeptide of the multi-chain chimeric polypeptide includes a second domain of a pair of affinity domains, wherein the first domain of the pair of affinity domains, the second domain of the pair of affinity domains, or both is about 10 to 100 amino acids in length. For example, a first domain of a pair of affinity domains, a second domain of a pair of affinity domains, or both can be about 10 to 100 amino acids in length, about 15 to 100 amino acids in length, about 20 to 100 amino acids in length, about 25 to 100 amino acids in length, about 30 to 100 amino acids in length, about 35 to 100 amino acids in length, about 40 to 100 amino acids in length, about 45 to 100 amino acids in length, about 50 to 100 amino acids in length, about 55 to 100 amino acids in length, about 60 to 100 amino acids in length, about 65 to 100 amino acids in length, about 70 to 100 amino acids in length, about 75 to 100 amino acids in length, about 80 to 100 amino acids in length, about 85 to 100 amino acids in length, about 90 to 100 amino acids in length, about 95 to 100 amino acids in length, about 10 to 95 amino acids in length, about 10 to 90 amino acids in length, about 10 to 85 amino acids in length, about 10 to 80 amino acids in length, about 10 to 75 amino acids in length, about 10 to 70 amino acids in length, about 10 to 65 amino acids in length, about 10 to 60 amino acids in length, about 10 to 55 amino acids in length, about 10 to 50 amino acids in length, about 10 to 45 amino acids in length, about 10 to 40 amino acids in length, about 10 to 35 amino acids in length, about 10 to 30 amino acids in length, about 10 to 25 amino acids in length, about 10 to 20 amino acids in length, about 10 to 15 amino acids in length, about 20 to 30 amino acids in length, about 30 to 40 amino acids in length, about 40 to 50 amino acids in length, about 50 to 60 amino acids in length, about 60 to 70 amino acids in length, about 70 to 80 amino acids in length, about 80 to 90 amino acids in length, about 90 to 100 amino acids in length, about 20 to 90 amino acids in length, about 30 to 80 amino acids in length, about 40 to 70 amino acids in length, about 50 to 60 amino acids in length, or any range in between. In some embodiments, a first domain of a pair of affinity domains, a second domain of a pair of affinity domains, or both is about 10, 15, 20, 25, 30, 35, 40, 45, 50, 55, 60, 65, 70, 75, 80, 85, 90, 95, or 100 amino acids in length.

In some embodiments, any of the first and/or second domains of a pair of affinity domains disclosed herein can include one or more additional amino acids (e.g., 1, 2, 3, 5, 6, 7, 8, 9, 10, or more amino acids) at its N-terminus and/or C-terminus, so long as the function of the first and/or second domains of a pair of affinity domains remains intact. For example, a sushi domain from an alpha chain of human IL-15 receptor (IL-15Rα) can include one or more additional amino acids at the N-terminus and/or the C-terminus, while still retaining the ability to bind to a soluble IL-15. Additionally or alternatively, a soluble IL-15 can include one or more additional amino acids at the N-terminus and/or the C-terminus, while still retaining the ability to bind to a sushi domain from an alpha chain of human IL-15 receptor (IL-15Rα).

A non-limiting example of a sushi domain from an alpha chain of IL-15 receptor alpha (IL-15Rα) can include a sequence that is at least 70% identical, at least 75% identical, at least 80% identical, at least 85% identical, at least 90% identical, at least 95% identical, at least 99% identical, or 100% identical to ITCPPPMSVEHADIWVKSYSLYSR-ERYICNSGFKRKAGTSSLTECVLNKATNVAH WTTPSLKCIR (SEQ ID NO: 113). In some embodiments, a sushi domain from an alpha chain of IL-15Rα can be encoded by a nucleic acid including (SEQ ID NO: 114)
ATTACATGCCCCCCTCCCATGAGCGTGGAGCACGCCGACATCTGGGTGAA

GAGCTATAGCCTCTACAGCCGGGAGAGGTATATCTGTAACAGCGGCTTCA

AGAGGAAGGCCGGCACCAGCAGCCTCACCGAGTGCGTGCTGAATAAGGCT

ACCAACGTGGCTCACTGGACAACACCCTCTTTAAAGTGCATCCGG.

In some embodiments, a soluble IL-15 can include a sequence that is at least 70% identical, at least 75% identical, at least 80% identical, at least 85% identical, at least 90% identical, at least 95% identical, at least 99% identical, or 100% identical to NWVNVISDLKKIEDLIQSMHIDAT-LYTESDVHPSCKVTAMKCFLLELQVISLESGD ASIHDTVENLIILANNSLSSNGNVTESGCKE-CEELEEKNIKEFLQSFVHIVQMFINT S (SEQ ID NO: 115). In some embodiments, a soluble IL-15 can be encoded by a nucleic acid including the sequence of (SEQ ID NO: 116)
AACTGGGTGAACGTCATCAGCGATTTAAAGAAGATCGAAGATTTAATTCA

GTCCATGCATATCGACGCCACTTTATACACAGAATCCGACGTGCACCCCT

CTTGTAAGGTGACCGCCATGAAATGTTTTTTACTGGAGCTGCAAGTTATC

TCTTTAGAGAGCGGAGACGCTAGCATCCACGACACCGTGGAGAATTTAAT

CATTTTAGCCAATAACTCTTTATCCAGCAACGGCAACGTGACAGAGTCCG

GCTGCAAGGAGTGCGAAGAGCTGGAGGAGAAGAACATCAAGGAGTTTCTG

CAATCCTTTGTGCACATTGTCCAGATGTTCATCAATACCTCC.

Signal Sequence

In some embodiments, a single-chain chimeric polypeptide comprises a signal sequence at its N-terminal end. In some embodiments, a multi-chain chimeric polypeptide includes a first chimeric polypeptide that includes a signal sequence at its N-terminal end. In some embodiments, a multi-chain chimeric polypeptide includes a second chimeric polypeptide that includes a signal sequence at its N-terminal end. In some embodiments, both the first chimeric polypeptide of a multi-chain chimeric polypeptide and a second chimeric polypeptide of the multi-chain chimeric polypeptide include a signal sequence. As will be understood by those of ordinary skill in the art, a signal sequence is an amino acid sequence that is present at the N-terminus of a number of endogenously produced proteins that directs the protein to the secretory pathway (e.g., the protein is directed to reside in certain intracellular organelles, to reside in the cell membrane, or to be secreted from the cell). Signal sequences are heterogeneous and differ greatly in their primary amino acid sequences. However, signal sequences are typically 16 to 30 amino acids in length and include a hydrophilic, usually positively charged N-terminal region, a central hydrophobic domain, and a C-terminal region that contains the cleavage site for signal peptidase.

In some embodiments, a first chimeric polypeptide of a multi-chain chimeric polypeptide, a second chimeric polypeptide of the multi-chain chimeric polypeptide, or both, or a single-chain chimeric polypeptide, includes a signal sequence having an amino acid sequence MKWVTFISLL-FLFSSAYS (SEQ ID NO: 117). In some embodiments, a first chimeric polypeptide of a multi-chain chimeric polypeptide, a second chimeric polypeptide of the multi-chain chimeric polypeptide, or both, or a single-chain chimeric polypeptide, includes a signal sequence encoded by the nucleic acid sequence (SEQ ID NO: 118)
ATGAAATGGGTGACCTTTATTTCTTTACTGTTCCTCTTTAGCAGCGCCTA

CTCC, (SEQ ID NO: 119)
ATGAAGTGGGTCACATTTATCTCTTTACTGTTCCTCTTCTCCAGCGCCTA

CAGC,
or (SEQ ID NO: 120)
ATGAAATGGGTGACCTTTATTTCTTTACTGTTCCTCTTTAGCAGCGCCTA

CTCC.

In some embodiments, a first chimeric polypeptide of a multi-chain chimeric polypeptide, a second chimeric polypeptide of the multi-chain chimeric polypeptide, or both, or a single-chain chimeric polypeptide, includes a signal sequence having an amino acid sequence MKCLLY-LAFLFLGVNC (SEQ ID NO: 121). In some embodiments, a first chimeric polypeptide of a multi-chain chimeric polypeptide, a second chimeric polypeptide of the multi-chain chimeric polypeptide, or both, or a single-chain chimeric polypeptide, includes a signal sequence having an amino acid sequence MGQIVTMFEALPHIIDEVINIVIIV-LIIITSIKAVYNFATCGILALVSFLFLAGRSCG (SEQ ID NO: 122). In some embodiments, a first chimeric polypeptide of a multi-chain chimeric polypeptide, a second chimeric polypeptide of the multi-chain chimeric polypeptide, or both, or a single-chain chimeric polypeptide, includes a signal sequence having an amino acid sequence:

(SEQ ID NO: 123)
MPNHQSGSPTGSSDLLLSGKKQRPHLALRRKRRREMRKINRKVRRMNLAP

IKEKTAWQHLQALISEAEEVLKTSQTPQNSLTLFLALLSVLGPPVTG.

In some embodiments, a first chimeric polypeptide of a multi-chain chimeric polypeptide, a second chimeric polypeptide of the multi-chain chimeric polypeptide, or both, or a single-chain chimeric polypeptide, includes a signal sequence having an amino acid sequence MDSKGSSQKGSRLLLLLVVSNLLLCQGVVS (SEQ ID NO: 124). Those of ordinary skill in the art will be aware of other appropriate signal sequences for use in a first chimeric polypeptide and/or a second chimeric polypeptide of multi-chain chimeric polypeptides, or single-chain chimeric polypeptides described herein.

In some embodiments, a first chimeric polypeptide of a multi-chain chimeric polypeptide, a second chimeric polypeptide of the multi-chain chimeric polypeptide, or both, or a single-chain chimeric polypeptide, includes a signal sequence that is about 10 to 100 amino acids in length. For example, a signal sequence can be about 10 to 100 amino acids in length, about 15 to 100 amino acids in length, about 20 to 100 amino acids in length, about 25 to 100 amino acids in length, about 30 to 100 amino acids in length, about 35 to 100 amino acids in length, about 40 to 100 amino acids in length, about 45 to 100 amino acids in length, about 50 to 100 amino acids in length, about 55 to 100 amino acids in length, about 60 to 100 amino acids in length, about 65 to 100 amino acids in length, about 70 to 100 amino acids in length, about 75 to 100 amino acids in length, about 80 to 100 amino acids in length, about 85 to 100 amino acids in length, about 90 to 100 amino acids in length, about 95 to 100 amino acids in length, about 10 to 95 amino acids in length, about 10 to 90 amino acids in length, about 10 to 85 amino acids in length, about 10 to 80 amino acids in length, about 10 to 75 amino acids in length, about 10 to 70 amino acids in length, about 10 to 65 amino acids in length, about 10 to 60 amino acids in length, about 10 to 55 amino acids in length, about 10 to 50 amino acids in length, about 10 to 45 amino acids in length, about 10 to 40 amino acids in length, about 10 to 35 amino acids in length, about 10 to 30 amino acids in length, about 10 to 25 amino acids in length, about 10 to 20 amino acids in length, about 10 to 15 amino acids in length, about 20 to 30 amino acids in length, about 30 to 40 amino acids in length, about 40 to 50 amino acids in length, about 50 to 60 amino acids in length, about 60 to 70 amino acids in length, about 70 to 80 amino acids in length, about 80 to 90 amino acids in length, about 90 to 100 amino acids in length, about 20 to 90 amino acids in length, about 30 to 80 amino acids in length, about 40 to 70 amino acids in length, about 50 to 60 amino acids in length, or any range in between. In some embodiments, a signal sequence is about 10, 15, 20, 25, 30, 35, 40, 45, 50, 55, 60, 65, 70, 75, 80, 85, 90, 95, or 100 amino acids in length.

In some embodiments, any of the signal sequences disclosed herein can include one or more additional amino acids (e.g., 1, 2, 3, 5, 6, 7, 8, 9, 10, or more amino acids) at its N-terminus and/or C-terminus, so long as the function of the signal sequence remains intact. For example, a signal sequence having the amino acid sequence MKCLLY-LAFLFLGVNC (SEQ ID NO: 125) can include one or more additional amino acids at the N-terminus or C-terminus, while still retaining the ability to direct the a first chimeric polypeptide of a multi-chain chimeric polypeptide, a second chimeric polypeptide of the multi-chain chimeric polypeptide, or both, or a single-chain chimeric polypeptide, to the secretory pathway.

In some embodiments, a first chimeric polypeptide of a multi-chain chimeric polypeptide, a second chimeric polypeptide of the multi-chain chimeric polypeptide, or both, or a single-chain chimeric polypeptide, includes a signal sequence that directs the multi-chain chimeric polypeptide into the extracellular space. Such embodiments are useful in producing single-chain or multi-chain chimeric polypeptides that are relatively easy to be isolated and/or purified.

Peptide Tags

In some embodiments, a single-chain chimeric polypeptide includes a peptide tag (e.g., at the N-terminal end or the C-terminal end of the chimeric polypeptide). In some embodiments, a multi-chain chimeric polypeptide includes a first chimeric polypeptide that includes a peptide tag (e.g., at the N-terminal end or the C-terminal end of the first chimeric polypeptide). In some embodiments, a multi-chain chimeric polypeptide includes a second chimeric polypeptide that includes a peptide tag (e.g., at the N-terminal end or the C-terminal end of the second chimeric polypeptide). In some embodiments, both the first chimeric polypeptide of a multi-chain chimeric polypeptide and a second chimeric polypeptide of the multi-chain chimeric polypeptide include a peptide tag. In some embodiments, a first chimeric polypeptide of a multi-chain chimeric polypeptide, a second chimeric polypeptide of the multi-chain chimeric polypeptide, or both, or a single-chain chimeric polypeptide, includes two or more peptide tags.

Exemplary peptide tags that can be included in a first chimeric polypeptide of a multi-chain chimeric polypeptide, a second chimeric polypeptide of the multi-chain chimeric polypeptide, or both, or a single-chain chimeric polypeptide include, without limitation, AviTag (GLNDIFEAQK-IEWHE; SEQ ID NO: 126), a calmodulin-tag (KRRWK-KNFIAVSAANRFKKISSSGAL; SEQ ID NO: 127), a polyglutamate tag (EEEEEE; SEQ ID NO: 128), an E-tag (GAPVPYPDPLEPR; SEQ ID NO: 129), a FLAG-tag (DYKDDDDK; SEQ ID NO: 130), an HA-tag, a peptide from hemagglutinin (YPYDVPDYA; SEQ ID NO: 131), a his-tag (HHHHH (SEQ ID NO: 132); HHHHHH (SEQ ID NO: 133); HHHHHHH (SEQ ID NO: 134); HHHHHHHH (SEQ ID NO: 135); HHHHHHHHH (SEQ ID NO: 136); or HHHHHHHHHH (SEQ ID NO: 137)), a myc-tag (EQKLI-SEEDL; SEQ ID NO: 138), NE-tag (TKENPRSNQEE-SYDDNES; SEQ ID NO: 139), S-tag, (KETAAAKFER-QHMDS; SEQ ID NO: 140), SBP-tag (MDEKTTGWRGGHVVEGLAGELEQLRARLEHHPQ-GQREP; SEQ ID NO: 141), Softag 1 (SLAELLNAGLGGS; SEQ ID NO: 142), Softag 3 (TQDPSRVG; SEQ ID NO: 143), Spot-tag (PDRVRAVSHWSS; SEQ ID NO: 144), Strep-tag (WSHPQFEK; SEQ ID NO: 145), TC tag (CCPGCC; SEQ ID NO: 146), Ty tag (EVHTNQDPLD; SEQ ID NO: 147), V5 tag (GKPIPNPLLGLDST; SEQ ID NO: 148), VSV-tag (YTDIEMNRLGK; SEQ ID NO: 149), and Xpress tag (DLYDDDDK; SEQ ID NO: 150). In some embodiments, tissue factor protein is a peptide tag.

Peptide tags that can be included in a first chimeric polypeptide of a multi-chain chimeric polypeptide, a second chimeric polypeptide of the multi-chain chimeric polypeptide, or both, or a single-chain chimeric polypeptide can be used in any of a variety of applications related to the multi-chain or single-chain chimeric polypeptide, respectively. For example, a peptide tag can be used in the purification of a multi-chain or single-chain chimeric polypeptide. As one non-limiting example, a first chimeric polypeptide of a multi-chain chimeric polypeptide (e.g., a recombinantly expressed first chimeric polypeptide), a second chimeric polypeptide of the multi-chain chimeric polypeptide (e.g., a recombinantly expressed second chimeric polypeptide), or both, or a single-chain chimeric polypeptide, can include a myc tag; the multi-chain chimeric polypeptide that includes the myc-tagged first chimeric polypeptide, the myc-tagged second chimeric polypeptide, or both, or the myc-tagged single-chain chimeric polypeptide can be purified using an antibody that recognizes the myc tag(s). One non-limiting example of an antibody that recognizes a myc tag is 9E10, available from the non-commercial Developmental Studies Hybridoma Bank. As another non-limiting example, a first chimeric polypeptide of a multi-chain chimeric polypeptide (e.g., a recombinantly expressed first chimeric polypeptide), a second chimeric polypeptide of the multi-chain chimeric polypeptide (e.g., a recombinantly expressed second chimeric polypeptide), or both, or a single-chain chimeric polypeptide, can include a histidine tag; the multi-chain chimeric polypeptide that includes the histidine-tagged first chimeric polypeptide, the histidine-tagged second chimeric polypeptide, or both, or the histidine-tagged single-chain chimeric polypeptide can be purified using a nickel or cobalt chelate. Those of ordinary skill in the art will be aware of other suitable tags and agents that bind those tags for use in purifying a single-chain or multi-chain chimeric polypeptide. In some embodiments, a peptide tag is removed from the first chimeric polypeptide and/or the second chimeric polypeptide of the multi-chain chimeric polypeptide, or the single-chain chimeric polypeptide after purification. In some embodiments, a peptide tag is not removed from the first chimeric polypeptide and/or the second chimeric polypeptide of the multi-chain chimeric polypeptide, or the single-chain chimeric polypeptide, after purification.

Peptide tags that can be included in a first chimeric polypeptide of a multi-chain chimeric polypeptide, a second chimeric polypeptide of the multi-chain chimeric polypeptide, or both, or a single-chain chimeric polypeptide, can be used, for example, in immunoprecipitation of the multi-chain chimeric polypeptide or single-chain chimeric polypeptide, respectively, imaging of the multi-chain chimeric polypeptide or single-chain chimeric polypeptide, respectively (e.g., via Western blotting, ELISA, flow cytometry, and/or immunocytochemistry), and/or solubilization of the multi-chain chimeric polypeptide or single-chain chimeric polypeptide, respectively.

In some embodiments, a first chimeric polypeptide of a multi-chain chimeric polypeptide, a second chimeric polypeptide of the multi-chain chimeric polypeptide, or both, or a single-chain chimeric polypeptide, includes a peptide tag that is about 10 to 100 amino acids in length. For example, a peptide tag can be about 10 to 100 amino acids in length, about 15 to 100 amino acids in length, about 20 to 100 amino acids in length, about 25 to 100 amino acids in length, about 30 to 100 amino acids in length, about 35 to 100 amino acids in length, about 40 to 100 amino acids in length, about 45 to 100 amino acids in length, about 50 to 100 amino acids in length, about 55 to 100 amino acids in length, about 60 to 100 amino acids in length, about 65 to 100 amino acids in length, about 70 to 100 amino acids in length, about 75 to 100 amino acids in length, about 80 to 100 amino acids in length, about 85 to 100 amino acids in length, about 90 to 100 amino acids in length, about 95 to 100 amino acids in length, about 10 to 95 amino acids in length, about 10 to 90 amino acids in length, about 10 to 85 amino acids in length, about 10 to 80 amino acids in length, about 10 to 75 amino acids in length, about 10 to 70 amino acids in length, about 10 to 65 amino acids in length, about 10 to 60 amino acids in length, about 10 to 55 amino acids in length, about 10 to 50 amino acids in length, about 10 to 45 amino acids in length, about 10 to 40 amino acids in length, about 10 to 35 amino acids in length, about 10 to 30 amino acids in length, about 10 to 25 amino acids in length, about 10 to 20 amino acids in length, about 10 to 15 amino acids in length, about 20 to 30 amino acids in length, about 30 to 40 amino acids in length, about 40 to 50 amino acids in length, about 50 to 60 amino acids in length, about 60 to 70 amino acids in length, about 70 to 80 amino acids in length, about 80 to 90 amino acids in length, about 90 to 100 amino acids in length, about 20 to 90 amino acids in length, about 30 to 80 amino acids in length, about 40 to 70 amino acids in length, about 50 to 60 amino acids in length, or any range in between. In some embodiments, a peptide tag is about 10, 15, 20, 25, 30, 35, 40, 45, 50, 55, 60, 65, 70, 75, 80, 85, 90, 95, or 100 amino acids in length.

Peptide tags included in a first chimeric polypeptide of a multi-chain chimeric polypeptide, a second chimeric polypeptide of the multi-chain chimeric polypeptide, or both, or a single-chain chimeric polypeptide, can be of any suitable length. For example, peptide tags can be 5, 6, 7, 8, 9, 10, 11, 12, 13, 14, 15, 16, 17, 18, 19, 20, or more amino acids in length. In embodiments in which a single-chain or multi-chain chimeric polypeptide includes two or more peptide tags, the two or more peptide tags can be of the same or different lengths. In some embodiments, any of the peptide tags disclosed herein may include one or more additional amino acids (e.g., 1, 2, 3, 5, 6, 7, 8, 9, 10, or more amino acids) at the N-terminus and/or C-terminus, so long as the function of the peptide tag remains intact. For example, a myc tag having the amino acid sequence EQKLISEEDL (SEQ ID NO: 138) can include one or more additional amino acids (e.g., at the N-terminus and/or the C-terminus of the peptide tag), while still retaining the ability to be bound by an antibody (e.g., 9E10).

Exemplary Embodiments of Single-Chain Chimeric Polypeptides—Type A

In some embodiments of any of the single-chain chimeric polypeptides described herein, the first target-binding domain and/or the second target-binding domain can independently bind specifically to CD3 (e.g., human CD3) or CD28 (e.g., human CD28). In some embodiments, the first target-binding domain binds specifically to CD3 (e.g., human CD3) and the second target-binding domain binds specifically to CD28 (e.g., human CD28). In some embodiments, the first target-binding domain binds specifically to CD28 (e.g., human CD28) and the second target-binding domain binds specifically to CD3 (e.g., human CD3).

In some embodiments of these single-chain chimeric polypeptides, the first target-binding domain and the soluble tissue factor domain directly abut each other. In some embodiments of these single-chain chimeric polypeptides, the single-chain chimeric polypeptide further includes a linker sequence (e.g., any of the exemplary linkers described herein) between the first target-binding domain and the soluble tissue factor domain.

In some embodiments of these single-chain chimeric polypeptides, the soluble tissue factor domain and the second target-binding domain directly abut each other. In some embodiments of these single-chain chimeric polypeptides, the single-chain chimeric polypeptide further includes a linker sequence (e.g., any of the exemplary linkers described herein) between the soluble tissue factor domain and the second target-binding domain.

In some embodiments of these single-chain chimeric polypeptides, one or both of the first target-binding domain and the second target-binding domain is an antigen-binding domain. In some embodiments of these single-chain chimeric polypeptides, the first target-binding domain and the second target-binding domain are each an antigen-binding domain (e.g., any of the exemplary antigen-binding domains described herein). In some embodiments of these single-chain chimeric polypeptides, the antigen-binding domain includes a scFv or a single domain antibody.

A non-limiting example of an scFv that binds specifically to CD3 can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 151)
QIVLTQSPAIMSASPGEKVTMTCSASSSVSYMNWYQQKSGTSPKRWIYDT

SKLASGVPAHFRGSGSGTSYSLTISGMEAEDAATYYCQQWSSNPFTFGSG

TKLEINRGGGGSGGGGSGGGGSQVQLQQSGAELARPGASVKMSCKASGYT

FTRYTMHWVKQRPGQGLEWIGYINPSRGYTNYNQKFKDKATLTTDKSSST

AYMQLSSLTSEDSAVYYCARYYDDHYCLDYWGQGTTLTVSS.

In some embodiments, an scFv that binds specifically to CD3 can be encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 152)
CAGATCGTGCTGACCCAAAGCCCCGCCATCATGAGCGCTAGCCCCGGTGA

GAAGGTGACCATGACATGCTCCGCTTCCAGCTCCGTGTCCTACATGAACT

GGTATCAGCAGAAAAGCGGAACCAGCCCCAAAAGGTGGATCTACGACACC

AGCAAGCTGGCCTCCGGAGTGCCCGCTCATTTCCGGGGCTCTGGATCCGG

CACCAGCTACTCTTTAACCATTTCCGGCATGGAAGCTGAAGACGCTGCCA

CCTACTATTGCCAGCAATGGAGCAGCAACCCCTTCACATTCGGATCTGGC

ACCAAGCTCGAAATCAATCGTGGAGGAGGTGGCAGCGGCGGCGGTGGATC

CGGCGGAGGAGGAAGCCAAGTTCAACTCCAGCAGAGCGGCGCTGAACTGG

CCCGGCCCGGCGCCTCCGTCAAGATGAGCTGCAAGGCTTCCGGCTATACA

TTTACTCGTTACACAATGCATTGGGTCAAGCAGAGGCCCGGTCAAGGTTT

AGAGTGGATCGGATATATCAACCCTTCCCGGGGCTACACCAACTATAACC

AAAAGTTCAAGGATAAAGCCACTTTAACCACTGACAAGAGCTCCTCCACC

GCCTACATGCAGCTGTCCTCTTTAACCAGCGAGGACTCCGCTGTTTACTA

CTGCGCTAGGTATTACGACGACCACTACTGTTTAGACTATTGGGGACAAG

GTACCACTTTAACCGTCAGCAGC.

A non-limiting example of an scFv that binds specifically to CD28 can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 153)
VQLQQSGPELVKPGASVKMSCKASGYTFTSYVIQWVKQKPGQGLEWIGSI

NPYNDYTKYNEKFKGKATLTSDKSSITAYMEFSSLTSEDSALYYCARWGD

GNYWGRGTTLTVSSGGGGSGGGGSGGGGSDIEMTQSPAIMSASLGERVTM

TCTASSSVSSSYFHWYQQKPGSSPKLCIYSTSNLASGVPPRFSGSGSTSY

SLTISSMEAEDAATYFCHQYHRSPTFGGGTKLETKR.

In some embodiments, an scFv that binds specifically to CD28 can be encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 154)
GTCCAGCTGCAGCAGAGCGGACCCGAACTCGTGAAACCCGGTGCTTCCGT

GAAAATGTCTTGTAAGGCCAGCGGATACACCTTCACCTCCTATGTGATCC

AGTGGGTCAAACAGAAGCCCGGACAAGGTCTCGAGTGGATCGGCAGCATC

AACCCTTACAACGACTATACCAAATACAACGAGAAGTTTAAGGGAAAGGC

TACTTTAACCTCCGACAAAAGCTCCATCACAGCCTACATGGAGTTCAGCT

CTTTAACATCCGAGGACAGCGCTCTGTACTATTGCGCCCGGTGGGCGAC

GGCAATTACTGGGGACGGGGCACAACACTGACCGTGAGCAGCGGAGGCGG

AGGCTCCGGCGGAGGCGGATCTGGCGGTGGCGGCTCCGACATCGAGATGA

CCCAGTCCCCCGCTATCATGTCCGCCTCTTTAGGCGAGCGGGTCACAATG

ACTTGTACAGCCTCCTCCAGCGTCTCCTCCTCCTACTTCCATTGGTACCA

ACAGAAACCCGGAAGCTCCCCTAAACTGTGCATCTACAGCACCAGCAATC

TCGCCAGCGGCGTGCCCCCTAGGTTTTCCGGAAGCGGAAGCACCAGCTAC

TCTTTAACCATCTCCTCCATGGAGGCTGAGGATGCCGCCACCTACTTTTG

TCACCAGTACCACCGGTCCCCCACCTTCGGAGGCGGCACCAAACTGGAGA

CAAAGAGG.

In some embodiments of these single-chain chimeric polypeptides, the first target-binding domain and/or the second target-binding domain is a soluble receptor (e.g., a soluble CD28 receptor or a soluble CD3 receptor). In some embodiments of these single-chain chimeric polypeptides, the soluble tissue factor domain can be any of the exemplary soluble tissue factor domains described herein.

In some embodiments, a single-chain chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 155)
QIVLTQSPAIMSASPGEKVTMTCSASSSVSYMNWYQQKSGTSPKRWIYDT

SKLASGVPAHFRGSGSGTSYSLTISGMEAEDAATYYCQQWSSNPFTFGSG

TKLEINRGGGGSGGGGSGGGGSQVQLQQSGAELARPGASVKMSCKASGYT

FTRYTMHWVKQRPGQGLEWIGYINPSRGYTNYNQKFKDKATLTTDKSSST

AYMQLSSLTSEDSAVYYCARYYDDHYCLDYWGQGTTLTVSSSGTTNTVAA

YNLTWKSTNFKTILEWEPKPVNQVYTVQISTKSGDWKSKCFYTTDTECDL

TDEIVKDVKQTYLARVFSYPAGNVESTGSAGEPLYENSPEFTPYLETNLG

QPTIQSFEQVGTKVNVTVEDERTLVRRNNTFLSLRDVFGKDLIYTLYYWK

SSSSGKKTAKTNTNEFLIDVDKGENYCFSVQAVIPSRTVNRKSTDSPVEC

MGQEKGEFREVQLQQSGPELVKPGASVKMSCKASGYTFTSYVIQWVKQKP

GQGLEWIGSINPYNDYTKYNEKFKGKATLTSDKSSITAYMEFSSLTSEDS

-continued
ALYYCARWGDGNYWGRGTTLTVSSGGGGSGGGGSGGGGSDIEMTQSPAIM

SASLGERVTMTCTASSSVSSSYFHWYQQKPGSSPKLCIYSTSNLASGVPP

RFSGSGSTSYSLTISSMEAEDAATYFCHQYHRSPTFGGGTKLETKR.

In some embodiments, a single-chain chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 156)
CAGATCGTGCTGACCCAAAGCCCCGCCATCATGAGCGCTAGCCCCGGTGA

GAAGGTGACCATGACATGCTCCGCTTCCAGCTCCGTGTCCTACATGAACT

GGTATCAGCAGAAAAGCGGAACCAGCCCCAAAAGGTGGATCTACGACACC

AGCAAGCTGGCCTCCGGAGTGCCCGCTCATTTCCGGGGCTCTGGATCCGG

CACCAGCTACTCTTTAACCATTTCCGGCATGGAAGCTGAAGACGCTGCCA

CCTACTATTGCCAGCAATGGAGCAGCAACCCCTTCACATTCGGATCTGGC

ACCAAGCTCGAAATCAATCGTGGAGGAGGTGGCAGCGGCGGCGGTGGATC

CGGCGGAGGAGGAAGCCAAGTTCAACTCCAGCAGAGCGGCGCTGAACTGG

CCCGGCCCGGCGCCTCCGTCAAGATGAGCTGCAAGGCTTCCGGCTATACA

TTTACTCGTTACACAATGCATTGGGTCAAGCAGAGGCCCGGTCAAGGTTT

AGAGTGGATCGGATATATCAACCCTTCCCGGGGCTACACCAACTATAACC

AAAAGTTCAAGGATAAAGCCACTTTAACCACTGACAAGAGCTCCTCCACC

GCCTACATGCAGCTGTCCTCTTTAACCAGCGAGGACTCCGCTGTTTACTA

CTGCGCTAGGTATTACGACGACCACTACTGTTTAGACTATTGGGACAAG

GTACCACTTTAACCGTCAGCAGCTCCGGCACCACCAATACCGTGGCCGCT

TATAACCTCACATGGAAGAGCACCAACTTCAAGACAATTCTGGAATGGGA

ACCCAAGCCCGTCAATCAAGTTTACACCGTGCAGATCTCCACCAAATCCG

GAGACTGGAAGAGCAAGTGCTTCTACACAACAGACACCGAGTGTGATTTA

ACCGACGAAATCGTCAAGGACGTCAAGCAAACCTATCTGGCTCGGGTCTT

TTCCTACCCCGCTGGCAATGTCGAGTCCACCGGCTCCGCTGGCGAGCCTC

TCTACGAGAATTCCCCCGAATTCACCCCTTATTAGAGACCAATTTAGGC

CAGCCTACCATCCAGAGCTTCGAGCAAGTTGGCACCAAGGTGAACGTCAC

CGTCGAGGATGAAAGGACTTTAGTGCGGCGGAATAACACATTTTTATCCC

TCCGGGATGTGTTCGGCAAAGACCTCATCTACACACTGTACTATTGGAAG

TCCAGCTCCTCCGGCAAAAAGACCGCTAAGACCAACACCAACGAGTTTTT

AATTGACGTGGACAAAGGCGAGAACTACTGCTTCAGCGTGCAAGCCGTGA

TCCCTTCTCGTACCGTCAACCGGAAGAGCACAGATTCCCCCGTTGAGTGC

ATGGGCCAAGAAAAGGGCGAGTTCCGGGAGGTCCAGCTGCAGCAGAGCGG

ACCCGAACTCGTGAAACCCGGTGCTTCCGTGAAAATGTCTTGTAAGGCCA

GCGGATACACCTTCACCTCCTATGTGATCCAGTGGGTCAAACAGAAGCCC

GGACAAGGTCTCGAGTGGATCGGCAGCATCAACCCTTACAACGACTATAC

CAAATACAACGAGAAGTTTAAGGGAAAGGCTACTTTAACCTCCGACAAA

-continued

GCTCCATCACAGCCTACATGGAGTTCAGCTCTTTAACATCCGAGGACAGC

GCTCTGTACTATTGCGCCCGGTGGGGCGACGGCAATTACTGGGGACGGGG

CACAACACTGACCGTGAGCAGCGGAGGCGGAGGCTCCGGCGGAGGCGGAT

CTGGCGGTGGCGGCTCCGACATCGAGATGACCCAGTCCCCCGCTATCATG

TCCGCCTCTTTAGGCGAGCGGGTCACAATGACTTGTACAGCCTCCTCCAG

CGTCTCCTCCTCCTACTTCCATTGGTACCAACAGAAACCCGGAAGCTCCC

CTAAACTGTGCATCTACAGCACCAGCAATCTCGCCAGCGGCGTGCCCCCT

AGGTTTTCCGGAAGCGGAAGCACCAGCTACTCTTTAACCATCTCCTCCAT

GGAGGCTGAGGATGCCGCCACCTACTTTGTCACCAGTACCACCGGTCCC

CCACCTTCGGAGGCGGCACCAAACTGGAGACAAAGAGG.

In some embodiments, a single-chain chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 157)
MKWVTFISLLFLFSSAYSQIVLTQSPAIMSASPGEKVTMTCSASSSVSYM

NWYQQKSGTSPKRWIYDTSKLASGVPAHFRGSGSGTSYSLTISGMEAEDA

ATYYCQQWSSNPFTFGSGTKLEINRGGGGSGGGGSGGGGSQVQLQQSGAE

LARPGASVKMSCKASGYTFTRYTMHWVKQRPGQGLEWIGYINPSRGYTNY

NQKFKDKATLTTDKSSSTAYMQLSSLTSEDSAVYYCARYYDDHYCLDYWG

QGTTLTVSSSGTTNTVAAYNLTWKSTNFKTILEWEPKPVNQVYTVQISTK

SGDWKSKCFYTTDTECDLTDEIVKDVKQTYLARVFSYPAGNVESTGSAGE

PLYENSPEFTPYLETNLGQPTIQSFEQVGTKVNVTVEDERTLVRRNNTFL

SLRDVFGKDLIYTLYYWKSSSSGKKTAKTNTNEFLIDVDKGENYCFSVQA

VIPSRTVNRKSTDSPVECMGQEKGEFREVQLQQSGPELVKPGASVKMSCK

ASGYTFTSYVIQWVKQKPGQGLEWIGSINPYNDYTKYNEKFKGKATLTSD

KSSITAYMEFSSLTSEDSALYYCARWGDGNYWGRGTTLTVSSGGGGSGGG

GSGGGGSDIEMTQSPAIMSASLGERVTMTCTASSSVSSSYFHWYQQKPGS

SPKLCIYSTSNLASGVPPRFSGSGSTSYSLTISSMEAEDAATYFCHQYHR

SPTFGGGTKLETKR.

In some embodiments, a single-chain chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 158)
ATGAAGTGGGTGACCTTCATCAGCTTATTATTTTTATTCAGCTCCGCCTA

TTCCCAGATCGTGCTGACCCAAAGCCCCGCCATCATGAGCGCTAGCCCCG

GTGAGAAGGTGACCATGACATGCTCCGCTTCCAGCTCCGTGTCCTACATG

AACTGGTATCAGCAGAAAAGCGGAACCAGCCCCAAAAGGTGGATCTACGA

CACCAGCAAGCTGGCCTCCGGAGTGCCCGCTCATTTCCGGGGCTCTGGAT

CCGGCACCAGCTACTCTTTAACCATTTCCGGCATGGAAGCTGAAGACGCT

GCCACCTACTATTGCCAGCAATGGAGCAGCAACCCCTTCACATTCGGATC

TGGCACCAAGCTCGAAATCAATCGTGGAGGAGGTGGCAGCGGCGGCGGTG

GATCCGGCGGAGGAGGAAGCCAAGTTCAACTCCAGCAGAGCGGCGCTGAA

CTGGCCCGGCCCGGCGCCTCCGTCAAGATGAGCTGCAAGGCTTCCGGCTA

TACATTTACTCGTTACACAATGCATTGGGTCAAGCAGAGGCCCGGTCAAG

GTTTAGAGTGGATCGGATATATCAACCCTTCCCGGGGCTACACCAACTAT

AACCAAAAGTTCAAGGATAAAGCCACTTTAACCACTGACAAGAGCTCCTC

CACCGCCTACATGCAGCTGTCCTCTTTAACCAGCGAGGACTCCGCTGTTT

ACTACTGCGCTAGGTATTACGACGACCACTACTGTTTAGACTATTGGGGA

CAAGGTACCACTTTAACCGTCAGCAGCTCCGGCACCACCAATACCGTGGC

CGCTTATAACCTCACATGGAAGAGCACCAACTTCAAGACAATTCTGGAAT

GGGAACCCAAGCCCGTCAATCAAGTTTACACCGTGCAGATCTCCACCAAA

TCCGGAGACTGGAAGAGCAAGTGCTTCTACACAACAGACACCGAGTGTGA

TTTAACCGACGAAATCGTCAAGGACGTCAAGCAAACCTATCTGGCTCGGG

TCTTTTCCTACCCCGCTGGCAATGTCGAGTCCACCGGCTCCGCTGGCGAG

CCTCTCTACGAGAATTCCCCCGAATTCACCCCTTATTTAGAGACCAATTT

AGGCCAGCCTACCATCCAGAGCTTCGAGCAAGTTGGCACCAAGGTGAACG

TCACCGTCGAGGATGAAAGGACTTTAGTGCGGCGGAATAACACATTTTTA

TCCCTCCGGGATGTGTTCGGCAAAGACCTCATCTACACACTGTACTATTG

GAAGTCCAGCTCCTCCGGCAAAAAGACCGCTAAGACCAACACCAACGAGT

TTTTAATTGACGTGGACAAAGGCGAGAACTACTGCTTCAGCGTGCAAGCC

GTGATCCCTTCTCGTACCGTCAACCGGAAGAGCACAGATTCCCCCGTTGA

GTGCATGGGCCAAGAAAAGGGCGAGTTCCGGGAGGTCCAGCTGCAGCAGA

GCGGACCCGAACTCGTGAAACCCGGTGCTTCCGTGAAAATGTCTTGTAAG

GCCAGCGGATACACCTTCACCTCCTATGTGATCCAGTGGGTCAAACAGAA

GCCCGGACAAGGTCTCGAGTGGATCGGCAGCATCAACCCTTACAACGACT

ATACCAAATACAACGAGAAGTTTAAGGGAAAGGCTACTTTAACCTCCGAC

AAAAGCTCCATCACAGCCTACATGGAGTTCAGCTCTTTAACATCCGAGGA

CAGCGCTCTGTACTATTGCGCCCGGTGGGGCGACGGCAATTACTGGGGAC

GGGGCACAACACTGACCGTGAGCAGCGGAGGCGGAGGCTCCGGCGGAGGC

GGATCTGGCGGTGGCGGCTCCGACATCGAGATGACCCAGTCCCCCGCTAT

CATGTCCGCCTCTTTAGGCGAGCGGGTCACAATGACTTGTACAGCCTCCT

CCAGCGTCTCCTCCTCCTACTTCCATTGGTACCAACAGAAACCCGGAAGC

TCCCCTAAACTGTGCATCTACAGCACCAGCAATCTCGCCAGCGGCGTGCC

CCCTAGGTTTTCCGGAAGCGGAAGCACCAGCTACTCTTTAACCATCTCCT

CCATGGAGGCTGAGGATGCCGCCACCTACTTTGTCACCAGTACCACCGG

TCCCCCACCTTCGGAGGCGGCACCAAACTGGAGACAAAGAGG.

Exemplary Embodiments of Single-Chain Chimeric Polypeptides—Type B

In some embodiments of any of the single-chain chimeric polypeptides described herein, the first target-binding domain and/or the second target-binding domain can independently bind specifically to an IL-2 receptor (e.g., human IL-2 receptor).

In some embodiments of these single-chain chimeric polypeptides, the first target-binding domain and the soluble tissue factor domain directly abut each other. In some embodiments of these single-chain chimeric polypeptides, the single-chain chimeric polypeptide further includes a linker sequence (e.g., any of the exemplary linkers described herein) between the first target-binding domain and the soluble tissue factor domain.

In some embodiments of these single-chain chimeric polypeptides, the soluble tissue factor domain and the second target-binding domain directly abut each other. In some embodiments of these single-chain chimeric polypeptides, the single-chain chimeric polypeptide further includes a linker sequence (e.g., any of the exemplary linkers described herein) between the soluble tissue factor domain and the second target-binding domain.

In some embodiments of these single-chain chimeric polypeptides, the first target-binding domain and the second target-binding domain is a soluble human IL-2 protein. A non-limiting example of an IL-2 protein that binds specifically to an IL-2 receptor can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 78)
APTSSSTKKTQLQLEHLLLDLQMILNGINNYKNPKLTRMLTFKFYMPKKA

TELKHLQCLEEELKPLEEVLNLAQSKNFHLRPRDLISNINVIVLELKGSE

TTFMCEYADETATIVEFLNRWITFCQSIISTLT.

In some embodiments, an IL-2 protein that binds specifically to an IL-2 receptor can be encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 159)
GCACCTACTTCAAGTTCTACAAAGAAAACACAGCTACAACTGGAGCATTT

ACTGCTGGATTTACAGATGATTTTGAATGGAATTAATAATTACAAGAATC

CCAAACTCACCAGGATGCTCACATTTAAGTTTTACATGCCCAAGAAGGCC

ACAGAACTGAAACATCTTCAGTGTCTAGAAGAAGAACTCAAACCTCTGGA

GGAAGTGCTAAATTTAGCTCAAAGCAAAAACTTTCACTTAAGACCCAGGG

ACTTAATCAGCAATATCAACGTAATAGTTCTGGAACTAAAGGGATCTGAA

ACAACATTCATGTGTGAATATGCTGATGAGACAGCAACCATTGTAGAATT

TCTGAACAGATGGATTACCTTTTGTCAAAGCATCATCTCAACACTAACT.

In some embodiments, an IL-2 protein that binds specifically to an IL-2 receptor can be encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 160)
GCCCCCACCTCCTCCTCCACCAAGAAGACCCAGCTGCAGCTGGAGCATTT

ACTGCTGGATTTACAGATGATTTTAAACGGCATCAACAACTACAAGAACC

CCAAGCTGACTCGTATGCTGACCTTCAAGTTCTACATGCCCAAGAAGGCC

ACCGAGCTGAAGCATTTACAGTGTTTAGAGGAGGAGCTGAAGCCCCTCGA

GGAGGTGCTGAATTTAGCCCAGTCCAAGAATTTCCATTTAAGGCCCCGGG

ATTTAATCAGCAACATCAACGTGATCGTTTTAGAGCTGAAGGGCTCCGAG

ACCACCTTCATGTGCGAGTACGCCGACGAGACCGCCACCATCGTGGAGTT

TTTAAATCGTTGGATCACCTTCTGCCAGTCCATCATCTCCACTTTAACC.

In some embodiments of these single-chain chimeric polypeptides, the soluble tissue factor domain can be any of the exemplary soluble tissue factor domains described herein.

In some embodiments, a single-chain chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 161)
APTSSSTKKTQLQLEHLLLDLQMILNGINNYKNPKLTRMLTFKFYMPKKA

TELKHLQCLEEELKPLEEVLNLAQSKNFHLRPRDLISNINVIVLELKGSE

TTFMCEYADETATIVEFLNRWITFCQSIISTLTSGTTNTVAAYNLTWKST

NFKTILEWEPKPVNQVYTVQISTKSGDWKSKCFYTTDTECDLTDEIVKDV

KQTYLARVFSYPAGNVESTGSAGEPLYENSPEFTPYLETNLGQPTIQSFE

QVGTKVNVTVEDERTLVRRNNTFLSLRDVFGKDLIYTLYYWKSSSSGKKT

AKTNTNEFLIDVDKGENYCFSVQAVIPSRTVNRKSTDSPVECMGQEKGEF

REAPTSSSTKKTQLQLEHLLLDLQMILNGINNYKNPKLTRMLTFKFYMPK

KATELKHLQCLEEELKPLEEVLNLAQSKNFHLRPRDLISNINVIVLELKG

SETTFMCEYADETATIVEFLNRWITFCQSIISTLT.

In some embodiments, a single-chain chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 162)
GCCCCCACCTCCTCCTCCACCAAGAAGACCCAGCTGCAGCTGGAGCATTT

ACTGCTGGATTTACAGATGATTTTAAACGGCATCAACAACTACAAGAACC

CCAAGCTGACTCGTATGCTGACCTTCAAGTTCTACATGCCCAAGAAGGCC

ACCGAGCTGAAGCATTTACAGTGTTTAGAGGAGGAGCTGAAGCCCCTCGA

GGAGGTGCTGAATTTAGCCCAGTCCAAGAATTTCCATTTAAGGCCCCGGG

ATTTAATCAGCAACATCAACGTGATCGTTTTAGAGCTGAAGGGCTCCGAG

```
ACCACCTTCATGTGCGAGTACGCCGACGAGACCGCCACCATCGTGGAGTT

TTTAAATCGTTGGATCACCTTCTGCCAGTCCATCATCTCCACTTTAACCA

GCGGCACAACCAACACAGTCGCTGCCTATAACCTCACTTGGAAGAGCACC

AACTTCAAAACCATCCTCGAATGGGAACCCAAACCCGTTAACCAAGTTTA

CACCGTGCAGATCAGCACCAAGTCCGGCGACTGGAAGTCCAAATGTTTCT

ATACCACCGACACCGAGTGCGATCTCACCGATGAGATCGTGAAAGATGTG

AAACAGACCTACCTCGCCCGGGTGTTTAGCTACCCCGCCGGCAATGTGGA

GAGCACTGGTTCCGCTGGCGAGCCTTTATACGAGAACAGCCCCGAATTTA

CCCCTTACCTCGAGACCAATTTAGGACAGCCCACCATCCAAAGCTTTGAG

CAAGTTGGCACAAAGGTGAATGTGACAGTGGAGGACGAGCGGACTTTAGT

GCGGCGGAACAACACCTTTCTCAGCCTCCGGGATGTGTTCGGCAAAGATT

TAATCTACACACTGTATTACTGGAAGTCCTCTTCCTCCGGCAAGAAGACA

GCTAAAACCAACACAAACGAGTTTTTAATCGACGTGGATAAAGGCGAAAA

CTACTGTTTCAGCGTGCAAGCTGTGATCCCCTCCCGGACCGTGAATAGGA

AAAGCACCGATAGCCCCGTTGAGTGCATGGGCCAAGAAAAGGGCGAGTTC

CGGGAGGCACCTACTTCAAGTTCTACAAAGAAAACACAGCTACAACTGGA

GCATTTACTGCTGGATTTACAGATGATTTTGAATGGAATTAATAATTACA

AGAATCCCAAACTCACCAGGATGCTCACATTTAAGTTTTACATGCCCAAG

AAGGCCACAGAACTGAAACATCTTCAGTGTCTAGAAGAAGAACTCAAACC

TCTGGAGGAAGTGCTAAATTTAGCTCAAAGCAAAAACTTTCACTTAAGAC

CCAGGGACTTAATCAGCAATATCAACGTAATAGTTCTGGAACTAAAGGGA

TCTGAAACAACATTCATGTGTGAATATGCTGATGAGACAGCAACCATTGT

AGAATTTCTGAACAGATGGATTACCTTTTGTCAAAGCATCATCTCAACAC

TAACT.
```

In some embodiments, a single-chain chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                       (SEQ ID NO: 163)
MKWVTFISLLFLFSSAYSAPTSSSTKKTQLQLEHLLLDLQMILNGINNYK

NPKLTRMLTFKFYMPKKATELKHLQCLEEELKPLEEVLNLAQSKNFHLRP

RDLISNINVIVLELKGSETTFMCEYADETATIVEFLNRWITFCQSIISTL

TSGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFREAPTSSSTKKTQLQLEHLLLDLQMILNGINN

YKNPKLTRMLTFKFYMPKKATELKHLQCLEEELKPLEEVLNLAQSKNFHL

RPRDLISNINVIVLELKGSETTFMCEYADETATIVEFLNRWITFCQSIIS

TLT.
```

In some embodiments, a single-chain chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                       (SEQ ID NO: 164)
ATGAAGTGGGTGACCTTCATCAGCCTGCTGTTCCTGTTCTCCAGCGCCTA

CTCCGCCCCCACCTCCTCCTCCACCAAGAAGACCCAGCTGCAGCTGGAGC

ATTTACTGCTGGATTTACAGATGATTTTAAACGGCATCAACAACTACAAG

AACCCCAAGCTGACTCGTATGCTGACCTTCAAGTTCTACATGCCCAAGAA

GGCCACCGAGCTGAAGCATTTACAGTGTTTAGAGGAGGAGCTGAAGCCCC

TCGAGGAGGTGCTGAATTTAGCCCAGTCCAAGAATTTCCATTTAAGGCCC

CGGGATTTAATCAGCAACATCAACGTGATCGTTTTAGAGCTGAAGGGCTC

CGAGACCACCTTCATGTGCGAGTACGCCGACGAGACCGCCACCATCGTGG

AGTTTTTAAATCGTTGGATCACCTTCTGCCAGTCCATCATCTCCACTTTA

ACCAGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAGGCACCTACTTCAAGTTCTACAAAGAAAACACAGCTACAAC

TGGAGCATTTACTGCTGGATTTACAGATGATTTTGAATGGAATTAATAAT

TACAAGAATCCCAAACTCACCAGGATGCTCACATTTAAGTTTTACATGCC

CAAGAAGGCCACAGAACTGAAACATCTTCAGTGTCTAGAAGAAGAACTCA

AACCTCTGGAGGAAGTGCTAAATTTAGCTCAAAGCAAAAACTTTCACTTA

AGACCCAGGGACTTAATCAGCAATATCAACGTAATAGTTCTGGAACTAAA

GGGATCTGAAACAACATTCATGTGTGAATATGCTGATGAGACAGCAACCA

TTGTAGAATTTCTGAACAGATGGATTACCTTTTGTCAAAGCATCATCTCA

ACACTAACT.
```

Exemplary Embodiments of Single-Chain Chimeric Polypeptides—Type C

In some embodiments of any of the single-chain chimeric polypeptides described herein, the first target-binding domain and/or the second target-binding domain can independently bind specifically to an IL-15 receptor (e.g., a human IL-15 receptor).

In some embodiments of these single-chain chimeric polypeptides, the first target-binding domain and the soluble tissue factor domain directly abut each other. In some embodiments of these single-chain chimeric polypeptides, the single-chain chimeric polypeptide further includes a linker sequence (e.g., any of the exemplary linkers described herein) between the first target-binding domain and the soluble tissue factor domain.

In some embodiments of these single-chain chimeric polypeptides, the soluble tissue factor domain and the second target-binding domain directly abut each other. In some embodiments of these single-chain chimeric polypeptides, the single-chain chimeric polypeptide further includes a linker sequence (e.g., any of the exemplary linkers described herein) between the soluble tissue factor domain and the second target-binding domain.

In some embodiments of these single-chain chimeric polypeptides, the first target-binding domain and the second target-binding domain is a soluble human IL-15 protein. A non-limiting example of an IL-15 protein that binds specifically to an IL-15 receptor can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 82)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS.

In some embodiments, an IL-15 protein that binds specifically to an IL-15 receptor can be encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 165)
AACTGGGTGAACGTGATCAGCGATTTAAAGAAGATCGAGGATTTAATCCA

GAGCATGCACATCGACGCCACTCTGTACACTGAGAGCGACGTGCACCCTA

GCTGCAAGGTGACTGCCATGAAGTGCTTTTTACTGGAGCTGCAAGTTATC

TCTTTAGAGAGCGGCGATGCCAGCATCCACGACACTGTGGAGAATTTAAT

CATTTTAGCCAACAACTCTTTAAGCAGCAACGGCAACGTGACAGAGAGCG

GCTGCAAGGAGTGCGAGGAGCTGGAGGAGAAGAACATCAAGGAGTTTTTA

CAGAGCTTCGTGCACATCGTGCAGATGTTCATCAACACTAGC.

In some embodiments, an IL-15 protein that binds specifically to an IL-15 receptor can be encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 166)
AACTGGGTGAACGTCATCAGCGATTTAAAGAAGATCGAAGATTTAATTCA

GTCCATGCATATCGACGCCACTTTATACACAGAATCCGACGTGCACCCCT

CTTGTAAGGTGACCGCCATGAAATGTTTTTTACTGGAGCTGCAAGTTATC

TCTTTAGAGAGCGGAGACGCTAGCATCCACGACACCGTGGAGAATTTAAT

CATTTTAGCCAATAACTCTTTATCCAGCAACGGCAACGTGACAGAGTCCG

GCTGCAAGGAGTGCGAAGAGCTGGAGGAGAAGAACATCAAGGAGTTTCTG

CAATCCTTTGTGCACATTGTCCAGATGTTCATCAATACCTCC.

In some embodiments of these single-chain chimeric polypeptides, the soluble tissue factor domain can be any of the exemplary soluble tissue factor domains described herein.

In some embodiments, a single-chain chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 167)
NWVNVISDLKKIEDLIQSMHIDATLYTESDVHPSCKVTAMKCFLLELQVI

SLESGTSSGTTNTVAAYNLTWKSTNFKTILEWEPKPVNQVYTVQISTKSG

DWKSKCFYTDASIHDTVENLIILANNSLSSNGNVTESGCKECEELEEKNI

KEFLQSFVHIVQMFINTDTECDLTDEIVKDVKQTYLARVFSYPAGNVEST

GSAGEPLYENSPEFTPYLETNLGQPTIQSFEQVGTKVNVTVEDERTLVRR

NNTFLSLRDVFGKDLIYTLYYWKSSSSGKKTAKTNTNEFLIDVDKGENYC

FSVQAVIPSRTVNRKSTDSPVECMGQEKGEFRENWVNVISDLKKIEDLIQ

SMHIDATLYTESDVHPSCKVTAMKCFLLELQVISLESGDASIHDTVENLI

ILANNSLSSNGNVTESGCKECEELEEKNIKEFLQSFVHIVQMFINTS.

In some embodiments, a single-chain chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 168)
AACTGGGTGAACGTGATCAGCGATTTAAAGAAGATCGAGGATTTAATCCA

GAGCATGCACATCGACGCCACTCTGTACACTGAGAGCGACGTGCACCCTA

GCTGCAAGGTGACTGCCATGAAGTGCTTTTTACTGGAGCTGCAAGTTATC

TCTTTAGAGAGCGGCGATGCCAGCATCCACGACACTGTGGAGAATTTAAT

CATTTTAGCCAACAACTCTTTAAGCAGCAACGGCAACGTGACAGAGAGCG

GCTGCAAGGAGTGCGAGGAGCTGGAGGAGAAGAACATCAAGGAGTTTTTA

CAGAGCTTCGTGCACATCGTGCAGATGTTCATCAACACTAGCAGCGGCAC

AACCAACACAGTCGCTGCCTATAACCTCACTTGGAAGAGCACCAACTTCA

AAACCATCCTCGAATGGGAACCCAAACCCGTTAACCAAGTTTACACCGTG

CAGATCAGCACCAAGTCCGGCGACTGGAAGTCCAAATGTTTCTATACCAC

-continued

CGACACCGAGTGCGATCTCACCGATGAGATCGTGAAAGATGTGAAACAGA

CCTACCTCGCCCGGGTGTTTAGCTACCCCGCCGGCAATGTGGAGAGCACT

GGTTCCGCTGGCGAGCCTTTATACGAGAACAGCCCCGAATTTACCCCTTA

CCTCGAGACCAATTTAGGACAGCCCACCATCCAAAGCTTTGAGCAAGTTG

GCACAAAGGTGAATGTGACAGTGGAGGACGAGCGGACTTTAGTGCGGCGG

AACAACACCTTTCTCAGCCTCCGGGATGTGTTCGGCAAAGATTTAATCTA

CACACTGTATTACTGGAAGTCCTCTTCCTCCGGCAAGAAGACAGCTAAAA

CCAACACAAACGAGTTTTTAATCGACGTGGATAAAGGCGAAAACTACTGT

TTCAGCGTGCAAGCTGTGATCCCCTCCCGGACCGTGAATAGGAAAAGCAC

CGATAGCCCCGTTGAGTGCATGGGCCAAGAAAAGGGCGAGTTCCGGGAGA

ACTGGGTGAACGTCATCAGCGATTTAAAGAAGATCGAAGATTTAATTCAG

TCCATGCATATCGACGCCACTTTATACACAGAATCCGACGTGCACCCCTC

TTGTAAGGTGACCGCCATGAAATGTTTTTACTGGAGCTGCAAGTTATCT

CTTTAGAGAGCGGAGACGCTAGCATCCACGACACCGTGGAGAATTTAATC

ATTTTAGCCAATAACTCTTTATCCAGCAACGGCAACGTGACAGAGTCCGG

CTGCAAGGAGTGCGAAGAGCTGGAGGAGAAGAACATCAAGGAGTTTCTGC

AATCCTTTGTGCACATTGTCCAGATGTTCATCAATACCTCC.

In some embodiments, a single-chain chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 169)
MKWVTFISLLFLFSSAYSNWVNVISDLKKIEDLIQSMHIDATLYTESDVH

PSCKVTAMKCFLLELQVISLESGDASIHDTVENLIILANNSLSSNGNVTE

SGCKECEELEEKNIKEFLQSFVHIVQMFINTSSGTTNTVAAYNLTWKSTN

FKTILEWEPKPVNQVYTVQISTKSGDWKSKCFYTTDTECDLTDEIVKDVK

QTYLARVFSYPAGNVESTGSAGEPLYENSPEFTPYLETNLGQPTIQSFEQ

VGTKVNVTVEDERTLVRRNNTFLSLRDVFGKDLIYTLYYWKSSSSGKKTA

KTNTNEFLIDVDKGENYCFSVQAVIPSRTVNRKSTDSPVECMGQEKGEFR

ENWVNVISDLKKIEDLIQSMHIDATLYTESDVHPSCKVTAMKCFLLELQV

ISLESGDASIHDTVENLIILANNSLSSNGNVTESGCKECEELEEKNIKEF

LQSFVHIVQMFINTS.

In some embodiments, a single-chain chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 170)
ATGAAGTGGGTGACCTTCATCAGCCTGCTGTTCCTGTTCTCCAGCGCCTA

CTCCAACTGGGTGAACGTGATCAGCGATTTAAAGAAGATCGAGGATTTAA

TCCAGAGCATGCACATCGACGCCACTCTGTACACTGAGAGCGACGTGCAC

CCTAGCTGCAAGGTGACTGCCATGAAGTGCTTTTTACTGGAGCTGCAAGT

TATCTCTTTAGAGAGCGGCGATGCCAGCATCCACGACACTGTGGAGAATT

TAATCATTTTAGCCAACAACTCTTTAAGCAGCAACGGCAACGTGACAGAG

AGCGGCTGCAAGGAGTGCGAGGAGCTGGAGGAGAAGAACATCAAGGAGTT

TTTACAGAGCTTCGTGCACATCGTGCAGATGTTCATCAACACTAGCAGCG

GCACAACCAACACAGTCGCTGCCTATAACCTCACTTGGAAGAGCACCAAC

TTCAAAACCATCCTCGAATGGGAACCCAAACCCGTTAACCAAGTTTACAC

CGTGCAGATCAGCACCAAGTCCGGCGACTGGAAGTCCAAATGTTTCTATA

CCACCGACACCGAGTGCGATCTCACCGATGAGATCGTGAAAGATGTGAAA

CAGACCTACCTCGCCCGGGTGTTTAGCTACCCCGCCGGCAATGTGGAGAG

CACTGGTTCCGCTGGCGAGCCTTTATACGAGAACAGCCCCGAATTTACCC

CTTACCTCGAGACCAATTTAGGACAGCCCACCATCCAAAGCTTTGAGCAA

GTTGGCACAAAGGTGAATGTGACAGTGGAGGACGAGCGGACTTTAGTGCG

GCGGAACAACACCTTTCTCAGCCTCCGGGATGTGTTCGGCAAAGATTTAA

TCTACACACTGTATTACTGGAAGTCCTCTTCCTCCGGCAAGAAGACAGCT

AAAACCAACACAAACGAGTTTTTAATCGACGTGGATAAAGGCGAAAACTA

CTGTTTCAGCGTGCAAGCTGTGATCCCCTCCCGGACCGTGAATAGGAAAA

GCACCGATAGCCCCGTTGAGTGCATGGGCCAAGAAAAGGGCGAGTTCCGG

GAGAACTGGGTGAACGTCATCAGCGATTTAAAGAAGATCGAAGATTTAAT

TCAGTCCATGCATATCGACGCCACTTTATACACAGAATCCGACGTGCACC

CCTCTTGTAAGGTGACCGCCATGAAATGTTTTTACTGGAGCTGCAAGTT

ATCTCTTTAGAGAGCGGAGACGCTAGCATCCACGACACCGTGGAGAATTT

AATCATTTTAGCCAATAACTCTTTATCCAGCAACGGCAACGTGACAGAGT

CCGGCTGCAAGGAGTGCGAAGAGCTGGAGGAGAAGAACATCAAGGAGTTT

CTGCAATCCTTTGTGCACATTGTCCAGATGTTCATCAATACCTCC.

Exemplary Multi-Chain Chimeric Polypeptides—Type A

In some embodiments of any of the multi-chain chimeric polypeptides described herein, the first target-binding domain and the second targeting-binding domain each independently bind specifically to a receptor of IL-18 or a receptor of IL-12. In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, one or both of the first target-binding domain and the second target-binding domain is an agonistic antigen-binding domain. In some embodiments of these multi-chain chimeric polypeptides, the first target-binding domain and the second target-binding domain are each agonistic antigen-binding domains. In some embodiments of these multi-chain chimeric polypeptides, the antigen-binding domain includes a scFv or single-domain antibody.

In some embodiments of these multi-chain chimeric polypeptides, one or both of the first target-binding domain and the second target-binding domain is a soluble IL-15 or a soluble IL-18. In some embodiments of these multi-chain chimeric polypeptides, the first target-binding domain and the second target-binding domain are each independently a soluble IL-15 or a soluble IL-18. In some embodiments of these multi-chain chimeric polypeptides, the first target-binding domain and the second target-binding domain both bind specifically to a receptor of IL-18 or a receptor of IL-12. In some embodiments of these multi-chain chimeric polypeptides, the first target-binding domain and the second target-binding domain bind specifically to the same epitope. In some embodiments of these multi-chain chimeric polypeptides, the first target-binding domain and the second target-binding domain include the same amino acid sequence.

In some embodiments of these multi-chain chimeric polypeptides, the first target-binding domain binds specifically to a receptor for IL-12, and the second target-binding domain binds specifically to a receptor for IL-18. In some embodiments of these multi-chain chimeric polypeptides, the first target-binding domain binds specifically to a receptor for IL-18, and the second target-binding domain bind specifically to a receptor for IL-12.

In some embodiments of these multi-chain chimeric polypeptides, the first target-binding domain includes a soluble IL-18 (e.g., a soluble human IL-18).

In some embodiments of these multi-chain chimeric polypeptides, the soluble human IL-18 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 109)
YFGKLESKLSVIRNLNDQVLFIDQGNRPLFEDMTDSDCRDNAPRTIFIIS

MYKDSQPRGMAVTISVKCEKISTLSCENKIISFKEMNPPDNIKDTKSDII

FFQRSVPGHDNKMQFESSSYEGYFLACEKERDLFKLILKKEDELGDRSIM

FTVQNED.

In some embodiments of these multi-chain chimeric polypeptides, the soluble human IL-18 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 171)
TACTTCGGCAAACTGGAATCCAAGCTGAGCGTGATCCGGAATTTAAACGA

CCAAGTTCTGTTTATCGATCAAGGTAACCGGCCTCTGTTCGAGGACATGA

CCGACTCCGATTGCCGGGACAATGCCCCCCGGACCATCTTCATTATCTCC

ATGTACAAGGACAGCCAGCCCCGGGGCATGGCTGTGACAATTAGCGTGAA

GTGTGAGAAAATCAGCACTTTATCTTGTGAGAACAAGATCATCTCCTTTA

AGGAAATGAACCCCCCCGATAACATCAAGGACACCAAGTCCGATATCATC

TTCTTCCAGCGGTCCGTGCCCGGTCACGATAACAAGATGCAGTTCGAATC

CTCCTCCTACGAGGGCTACTTTTTAGCTTGTGAAAAGGAGAGGGATTTAT

TCAAGCTGATCCTCAAGAAGGAGGACGAGCTGGGCGATCGTTCCATCATG

TTCACCGTCCAAAACGAGGAT.

In some embodiments of these multi-chain chimeric polypeptides, the second target-binding domain includes a soluble IL-12 (e.g., a soluble human IL-12). In some embodiments of these multi-chain chimeric polypeptides, the soluble human IL-15 includes a sequence of soluble human IL-12β (p40) and a sequence of soluble human IL-12α (p35). In some embodiments of these multi-chain chimeric polypeptides, the soluble IL-15 human IL-15 further includes a linker sequence (e.g., any of the exemplary linker sequences described herein) between the sequence of soluble IL-12β (p40) and the sequence of soluble human IL-12α (p35). In some examples of these multi-chain chimeric polypeptides, the linker sequence comprises GGGGSGGGGSGGGGS (SEQ ID NO: 102).

In some embodiments of these multi-chain chimeric polypeptides, the sequence of soluble human IL-12β (p40) comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 81)
IWELKKDVYVVELDWYPDAPGEMVVLTCDTPEEDGITWTLDQSSEVLGSG

KTLTIQVKEFGDAGQYTCHKGGEVLSHSLLLLHKKEDGIWSTDILKDQKE

PKNKTFLRCEAKNYSGRFTCWWLTTISTDLTFSVKSSRGSSDPQGVTCGA

ATLSAERVRGDNKEYEYSVECQEDSACPAAEESLPIEVMVDAVHKLKYEN

YTSSFFIRDIIKPDPPKNLQLKPLKNSRQVEVSWEYPDTWSTPHSYFSLT

FCVQVQGKSKREKKDRVFTDKTSATVICRKNASISVRAQDRYYSSSWSEW

ASVPCS.

In some embodiments of these multi-chain chimeric polypeptides, the soluble human IL-12β (p40) is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 172)
ATTTGGGAACTGAAGAAGGACGTCTACGTGGTCGAACTGGACTGGTATCC

CGATGCTCCCGGCGAAATGGTGGTGCTCACTTGTGACACCCCCGAAGAAG

ACGGCATCACTTGGACCCTCGATCAGAGCAGCGAGGTGCTGGGCTCCGGA

AAGACCCTCACAATCCAAGTTAAGGAGTTCGGAGACGCTGGCCAATACAC

ATGCCACAAGGGAGGCGAGGTGCTCAGCCATTCCTTATTATTATTACACA

AGAAGGAAGACGGAATCTGGTCCACCGACATTTTAAAAGATCAGAAGGAG

CCCAAGAATAAGACCTTTTTAAGGTGTGAGGCCAAAAACTACAGCGGTCG

TTTCACTTGTTGGTGGCTGACCACCATTTCCACCGATTTAACCTTCTCCG

TGAAAAGCAGCCGGGGAAGCTCCGACCCTCAAGGTGTGACATGTGGAGCC

GCTACCCTCAGCGCTGAGAGGGTTCGTGGCGATAACAAGGAATACGAGTA

CAGCGTGGAGTGCCAAGAAGATAGCGCTTGTCCCGCTGCCGAAGAATCTT

TACCCATTGAGGTGATGGTGGACGCCGTGCACAAACTCAAGTACGAGAAC

TACACCTCCTCCTTCTTTATCCGGGACATCATTAAGCCCGATCCTCCTAA

GAATTTACAGCTGAAGCCTCTCAAAAATAGCCGGCAAGTTGAGGTCTCTT

GGGAATATCCCGACACTTGGAGCACACCCCACAGCTACTTCTCTTTAACC

TTTTGTGTGCAAGTTCAAGGTAAAAGCAAGCGGGAGAAGAAAGACCGGGT

GTTTACCGACAAAACCAGCGCCACCGTCATCTGTCGGAAGAACGCCTCCA

TCAGCGTGAGGGCTCAAGATCGTTATTACTCCAGCAGCTGGTCCGAGTGG

GCCAGCGTGCCTTGTTCC.

In some embodiments of these multi-chain polypeptides, the soluble human IL-12α (p35) includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 80)
RNLPVATPDPGMFPCLHHSQNLLRAVSNMLQKARQTLEFYPCTSEEIDHE

DITKDKTSTVEACLPLELTKNESCLNSRETSFITNGSCLASRKTSFMMAL

CLSSIYEDLKMYQVEFKTMNAKLLMDPKRQIFLDQNMLAVIDELMQALNF

NSETVPQKSSLEEPDFYKTKIKLCILLHAFRIRAVTIDRVMSYLNAS.

In some embodiments of these multi-chain chimeric polypeptides, the soluble human IL-12α (p35) is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 173)
CGTAACCTCCCCGTGGCTACCCCCGATCCCGGAATGTTCCCTTGTTTACA

CCACAGCCAGAATTTACTGAGGGCCGTGAGCAACATGCTGCAGAAAGCTA

GGCAGACTTTAGAATTTTACCCTTGCACCAGCGAGGAGATCGACCATGAA

GATATCACCAAGGACAAGACATCCACCGTGGAGGCTTGTTTACCTCTGGA

GCTGACAAAGAACGAGTCTTGTCTCAACTCTCGTGAAACCAGCTTCATCA

CAAATGGCTCTTGTTTAGCTTCCCGGAAGACCTCCTTTATGATGGCTTTA

TGCCTCAGCTCCATCTACGAGGATTTAAAGATGTACCAAGTGGAGTTCAA

GACCATGAACGCCAAGCTGCTCATGGACCCTAAACGGCAGATCTTTTTAG

ACCAGAACATGCTGGCTGTGATTGATGAGCTGATGCAAGCTTTAAACTTC

AACTCCGAGACCGTCCCTCAGAAGTCCTCCCTCGAGGAGCCCGATTTTTA

CAAGACAAAGATCAAACTGTGCATTTTACTCCACGCCTTTAGGATCCGGG

CCGTGACCATTGACCGGGTCATGAGCTATTTAAACGCCAGC.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 174)
YFGKLESKLSVIRNLNDQVLFIDQGNRPLFEDMTDSDCRDNAPRTIFIIS

MYKDSQPRGMAVTISVKCEKISTLSCENKIISFKEMNPPDNIKDTKSDII

FFQRSVPGHDNKMQFESSSYEGYFLACEKERDLFKLILKKEDELGDRSIM

FTVQNEDSGTTNTVAAYNLTWKSTNFKTILEWEPKPVNQVYTVQISTKSG

DWKSKCFYTTDTECDLTDEIVKDVKQTYLARVFSYPAGNVESTGSAGEPL

YENSPEFTPYLETNLGQPTIQSFEQVGTKVNVTVEDERTLVRRNNTFLSL

RDVFGKDLIYTLYYWKSSSSGKKTAKTNTNEFLIDVDKGENYCFSVQAVI

PSRTVNRKSTDSPVECMGQEKGEFRENWVNVISDLKKIEDLIQSMHIDAT

LYTESDVHPSCKVTAMKCFLLELQVISLESGDASIHDTVENLIILANNSL

SSNGNVTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 175)
TACTTCGGCAAACTGGAATCCAAGCTGAGCGTGATCCGGAATTTAAACGA

CCAAGTTCTGTTTATCGATCAAGGTAACCGGCCTCTGTTCGAGGACATGA

CCGACTCCGATTGCCGGGACAATGCCCCCCGGACCATCTTCATTATCTCC

ATGTACAAGGACAGCCAGCCCCGGGGCATGGCTGTGACAATTAGCGTGAA

GTGTGAGAAAATCAGCACTTTATCTTGTGAGAACAAGATCATCTCCTTTA

AGGAAATGAACCCCCCCGATAACATCAAGGACACCAAGTCCGATATCATC

TTCTTCCAGCGGTCCGTGCCCGGTCACGATAACAAGATGCAGTTCGAATC

CTCCTCCTACGAGGGCTACTTTTTAGCTTGTGAAAAGGAGAGGGATTTAT

TCAAGCTGATCCTCAAGAAGGAGGACGAGCTGGGCGATCGTTCCATCATG

TTCACCGTCCAAAACGAGGATAGCGGCACAACCAACACAGTCGCTGCCTA

```
TAACCTCACTTGGAAGAGCACCAACTTCAAAACCATCCTCGAATGGGAAC

CCAAACCCGTTAACCAAGTTTACACCGTGCAGATCAGCACCAAGTCCGGC

GACTGGAAGTCCAAATGTTTCTATACCACCGACACCGAGTGCGATCTCAC

CGATGAGATCGTGAAAGATGTGAAACAGACCTACCTCGCCCGGGTGTTTA

GCTACCCCGCCGGCAATGTGGAGAGCACTGGTTCCGCTGGCGAGCCTTTA

TACGAGAACAGCCCCGAATTTACCCCTTACCTCGAGACCAATTTAGGACA

GCCCACCATCCAAAGCTTTGAGCAAGTTGGCACAAAGGTGAATGTGACAG

TGGAGGACGAGCGGACTTTAGTGCGGCGGAACAACACCTTTCTCAGCCTC

CGGGATGTGTTCGGCAAAGATTTAATCTACACACTGTATTACTGGAAGTC

CTCTTCCTCCGGCAAGAAGACAGCTAAAACCAACACAAACGAGTTTTTAA

TCGACGTGGATAAAGGCGAAAACTACTGTTTCAGCGTGCAAGCTGTGATC

CCCTCCCGGACCGTGAATAGGAAAAGCACCGATAGCCCCGTTGAGTGCAT

GGGCCAAGAAAAGGGCGAGTTCCGGGAGAACTGGGTGAACGTCATCAGCG

ATTTAAAGAAGATCGAAGATTTAATTCAGTCCATGCATATCGACGCCACT

TTATACACAGAATCCGACGTGCACCCCTCTTGTAAGGTGACCGCCATGAA

ATGTTTTTTACTGGAGCTGCAAGTTATCTCTTTAGAGAGCGGAGACGCTA

GCATCCACGACACCGTGGAGAATTTAATCATTTTAGCCAATAACTCTTTA

TCCAGCAACGGCAACGTGACAGAGTCCGGCTGCAAGGAGTGCGAAGAGCT

GGAGGAGAAGAACATCAAGGAGTTTCTGCAATCCTTTGTGCACATTGTCC

AGATGTTCATCAATACCTCC.
```

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 176)
MKWVTFISLLFLFSSAYSYFGKLESKLSVIRNLNDQVLFIDQGNRPLFED

MTDSDCRDNAPRTIFIISMYKDSQPRGMAVTISVKCEKISTLSCENKIIS

FKEMNPPDNIKDTKSDIIFFQRSVPGHDNKMQFESSSYEGYFLACEKERD

LFKLILKKEDELGDRSIMFTVQNEDSGTTNTVAAYNLTWKSTNFKTILEW

EPKPVNQVYTVQISTKSGDWKSKCFYTTDTECDLTDEIVKDVKQTYLARV

FSYPAGNVESTGSAGEPLYENSPEFTPYLETNLGQPTIQSFEQVGTKVNV

TVEDERTLVRRNNTFLSLRDVFGKDLIYTLYYWKSSSSGKKTAKTNTNEF

LIDVDKGENYCFSVQAVIPSRTVNRKSTDSPVECMGQEKGEFRENWVNVI

SDLKKIEDLIQSMHIDATLYTESDVHPSCKVTAMKCFLLELQVISLESGD

ASIHDTVENLIILANNSLSSNGNVTESGCKECEELEEKNIKEFLQSFVHI

VQMFINTS.
```

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 177)
ATGAAGTGGGTCACATTTATCTCTTTACTGTTCCTCTTCTCCAGCGCCTA

CAGCTACTTCGGCAAACTGGAATCCAAGCTGAGCGTGATCCGGAATTTAA

ACGACCAAGTTCTGTTTATCGATCAAGGTAACCGGCCTCTGTTCGAGGAC

ATGACCGACTCCGATTGCCGGGACAATGCCCCCCGGACCATCTTCATTAT

CTCCATGTACAAGGACAGCCAGCCCCGGGGCATGGCTGTGACAATTAGCG

TGAAGTGTGAGAAAATCAGCACTTTATCTTGTGAGAACAAGATCATCTCC

TTTAAGGAAATGAACCCCCCCGATAACATCAAGGACACCAAGTCCGATAT

CATCTTCTTCCAGCGGTCCGTGCCCGGTCACGATAACAAGATGCAGTTCG

AATCCTCCTCCTACGAGGGCTACTTTTTAGCTTGTGAAAAGGAGAGGGAT

TTATTCAAGCTGATCCTCAAGAAGGAGGACGAGCTGGGCGATCGTTCCAT

CATGTTCACCGTCCAAAACGAGGATAGCGGCACAACCAACACAGTCGCTG

CCTATAACCTCACTTGGAAGAGCACCAACTTCAAAACCATCCTCGAATGG

GAACCCAAACCCGTTAACCAAGTTTACACCGTGCAGATCAGCACCAAGTC

CGGCGACTGGAAGTCCAAATGTTTCTATACCACCGACACCGAGTGCGATC

TCACCGATGAGATCGTGAAAGATGTGAAACAGACCTACCTCGCCCGGGTG

TTTAGCTACCCCGCCGGCAATGTGGAGAGCACTGGTTCCGCTGGCGAGCC

TTTATACGAGAACAGCCCCGAATTTACCCCTTACCTCGAGACCAATTTAG

GACAGCCCACCATCCAAAGCTTTGAGCAAGTTGGCACAAAGGTGAATGTG

ACAGTGGAGGACGAGCGGACTTTAGTGCGGCGGAACAACACCTTTCTCAG

CCTCCGGGATGTGTTCGGCAAAGATTTAATCTACACACTGTATTACTGGA

AGTCCTCTTCCTCCGGCAAGAAGACAGCTAAAACCAACACAAACGAGTTT

TTAATCGACGTGGATAAAGGCGAAAACTACTGTTTCAGCGTGCAAGCTGT

GATCCCCTCCCGGACCGTGAATAGGAAAAGCACCGATAGCCCCGTTGAGT

GCATGGGCCAAGAAAAGGGCGAGTTCCGGGAGAACTGGGTGAACGTCATC

AGCGATTTAAAGAAGATCGAAGATTTAATTCAGTCCATGCATATCGACGC

CACTTTATACACAGAATCCGACGTGCACCCCTCTTGTAAGGTGACCGCCA

TGAAATGTTTTTTACTGGAGCTGCAAGTTATCTCTTTAGAGAGCGGAGAC

GCTAGCATCCACGACACCGTGGAGAATTTAATCATTTTAGCCAATAACTC

TTTATCCAGCAACGGCAACGTGACAGAGTCCGGCTGCAAGGAGTGCGAAG

AGCTGGAGGAGAAGAACATCAAGGAGTTTCTGCAATCCTTTGTGCACATT

GTCCAGATGTTCATCAATACCTCC.
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 178)
IWELKKDVYVVELDWYPDAPGEMVVLTCDTPEEDGITWTLDQSSEVLGSG

KTLTIQVKEFGDAGQYTCHKGGEVLSHSLLLLHKKEDGIWSTDILKDQKE

PKNKTFLRCEAKNYSGRFTCWWLTTISTDLTFSVKSSRGSSDPQGVTCGA
```

-continued

ATLSAERVRGDNKEYEYSVECQEDSACPAAEESLPIEVMVDAVHKLKYEN

YTSSFFIRDIIKPDPPKNLQLKPLKNSRQVEVSWEYPDTWSTPHSYFSLT

FCVQVQGKSKREKKDRVFTDKTSATVICRKNASISVRAQDRYYSSSWSEW

ASVPCSGGGGSGGGGSGGGGSRNLPVATPDPGMFPCLHHSQNLLRAVSNM

LQKARQTLEFYPCTSEEIDHEDITKDKTSTVEACLPLELTKNESCLNSRE

TSFITNGSCLASRKTSFMMALCLSSIYEDLKMYQVEFKTMNAKLLMDPKR

QIFLDQNMLAVIDELMQALNFNSETVPQKSSLEEPDFYKTKIKLCILLHA

FRIRAVTIDRVMSYLNASITCPPPMSVEHADIWVKSYSLYSRERYICNSG

FKRKAGTSSLTECVLNKATNVAHWTTPSLKCIR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 179)
ATTTGGGAACTGAAGAAGGACGTCTACGTGGTCGAACTGGACTGGTATCC

CGATGCTCCCGGCGAAATGGTGGTGCTCACTTGTGACACCCCCGAAGAAG

ACGGCATCACTTGGACCCTCGATCAGAGCAGCGAGGTGCTGGGCTCCGGA

AAGACCCTCACAATCCAAGTTAAGGAGTTCGGAGACGCTGGCCAATACAC

ATGCCACAAGGGAGGCGAGGTGCTCAGCCATTCCTTATTATTATTACACA

AGAAGGAAGACGGAATCTGGTCCACCGACATTTTAAAAGATCAGAAGGAG

CCCAAGAATAAGACCTTTTTAAGGTGTGAGGCCAAAAACTACAGCGGTCG

TTTCACTTGTTGGTGGCTGACCACCATTTCCACCGATTTAACCTTCTCCG

TGAAAAGCAGCCGGGGAAGCTCCGACCCTCAAGGTGTGACATGTGGAGCC

GCTACCCTCAGCGCTGAGAGGGTTCGTGGCGATAACAAGGAATACGAGTA

CAGCGTGGAGTGCCAAGAAGATAGCGCTTGTCCCGCTGCCGAAGAATCTT

TACCCATTGAGGTGATGGTGGACGCCGTGCACAAACTCAAGTACGAGAAC

TACACCTCCTCCTTCTTTATCCGGGACATCATTAAGCCCGATCCTCCTAA

GAATTTACAGCTGAAGCCTCTCAAAAATAGCCGGCAAGTTGAGGTCTCTT

GGGAATATCCCGACACTTGGAGCACACCCCACAGCTACTTCTCTTTAACC

TTTTGTGTGCAAGTTCAAGGTAAAAGCAAGCGGGAGAAGAAAGACCGGGT

GTTTACCGACAAAACCAGCGCCACCGTCATCTGTCGGAAGAACGCCTCCA

TCAGCGTGAGGGCTCAAGATCGTTATTACTCCAGCAGCTGGTCCGAGTGG

GCCAGCGTGCCTTGTTCCGGCGGTGGAGGATCCGGAGGAGGTGGCTCCGG

CGGCGGAGGATCTCGTAACCTCCCCGTGGCTACCCCCGATCCCGGAATGT

TCCCTTGTTTACACCACAGCCAGAATTTACTGAGGGCCGTGAGCAACATG

CTGCAGAAAGCTAGGCAGACTTTAGAATTTTACCCTTGCACCAGCGAGGA

GATCGACCATGAAGATATCACCAAGGACAAGACATCCACCGTGGAGGCTT

GTTTACCTCTGGAGCTGACAAAGAACGAGTCTTGTCTCAACTCTCGTGAA

ACCAGCTTCATCACAAATGGCTCTTGTTTAGCTTCCCGGAAGACCTCCTT

TATGATGGCTTTATGCCTCAGCTCCATCTACGAGGATTTAAAGATGTACC

-continued

AAGTGGAGTTCAAGACCATGAACGCCAAGCTGCTCATGGACCCTAAACGG

CAGATCTTTTTAGACCAGAACATGCTGGCTGTGATTGATGAGCTGATGCA

AGCTTTAAACTTCAACTCCGAGACCGTCCCTCAGAAGTCCTCCCTCGAGG

AGCCCGATTTTTACAAGACAAAGATCAAACTGTGCATTTTACTCCACGCC

TTTAGGATCCGGGCCGTGACCATTGACCGGGTCATGAGCTATTTAAACGC

CAGCATTACATGCCCCCCTCCCATGAGCGTGGAGCACGCCGACATCTGGG

TGAAGAGCTATAGCCTCTACAGCCGGGAGAGGTATATCTGTAACAGCGGC

TTCAAGAGGAAGGCCGGCACCAGCAGCCTCACCGAGTGCGTGCTGAATAA

GGCTACCAACGTGGCTCACTGGACAACACCCTCTTTAAAGTGCATCCGG.

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or or 100% identical) to:

(SEQ ID NO: 180)
MKWVTFISLLFLFSSAYSIWELKKDVYVVELDWYPDAPGEMVVLTCDTP

EEDGITWTLDQSSEVLGSGKTLTIQVKEFGDAGQYTCHKGGEVLSHSLL

LLHKKEDGIWSTDILKDQKEPKNKTFLRCEAKNYSGRFTCWWLTTISTD

LTFSVKSSRGSSDPQGVTCGAATLSAERVRGDNKEYEYSVECQEDSACP

AAEESLPIEVMVDAVHKLKYENYTSSFFIRDIIKPDPPKNLQLKPLKNS

RQVEVSWEYPDTWSTPHSYFSLTFCVQVQGKSKREKKDRVFTDKTSATV

ICRKNASISVRAQDRYYSSSWSEWASVPCSGGGGSGGGGSGGGGSRNLP

VATPDPGMFPCLHHSQNLLRAVSNMLQKARQTLEFYPCTSEEIDHEDIT

KDKTSTVEACLPLELTKNESCLNSRETSFITNGSCLASRKTSFMMALCL

SSIYEDLKMYQVEFKTMNAKLLMDPKRQIFLDQNMLAVIDELMQALNEN

SETVPQKSSLEEPDFYKTKIKLCILLHAFRIRAVTIDRVMSYLNASITC

PPPMSVEHADIWVKSYSLYSRERYICNSGFKRKAGTSSLTECVLNKATN

VAHWTTPSLKCIR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 181)
ATTTGGGAACTGAAGAAGGACGTCTACGTGGTCGAACTGGACTGGTATC

CCGATGCTCCCGGCGAAATGGTGGTGCTCACTTGTGACACCCCCGAAGA

AGACGGATGAAATGGGTGACCTTTATTTCTTTACTGTTCCTCTTTAGCA

GCGCCTACTCCCATCACTTGGACCCTCGATCAGAGCAGCGAGGTGCTGG

GCTCCGGAAAGACCCTCACAATCCAAGTTAAGGAGTTCGGAGACGCTGG

CCAATACACATGCCACAAGGGAGGCGAGGTGCTCAGCCATTCCTTATTA

-continued
```
TTATTACACAAGAAGGAAGACGGAATCTGGTCCACCGACATTTTAAAAG

ATCAGAAGGAGCCCAAGAATAAGACCTTTTTAAGGTGTGAGGCCAAAAA

CTACAGCGGTCGTTTCACTTGTTGGTGAGCTCCGACCCTCAAGGTGTGA

CATGTGGAGCCGCTACCCTCAGCGCTGAGAGCTGACCACCATTTCCACC

GATTTAACCTTCTCCGTGAAAAGCAGCCGGGGAGGGTTCGTGGCGATAA

CAAGGAATACGAGTACAGCGTGGAGTGCCAAGAAGATAGCGCTTGTCCC

GCTGCCGAAGAATCTTTACCCATTGAGGTGATGGTGGACGCCGTGCACA

AACTCAAGTACGAGAACTACACCTCCTCCTTCTTTATCCGGGACATCAT

TAAGCCCGATCCTCCTAAGAATTTACAGCTGAAGCCTCTCAAAAATAGC

CGGCAAGTTGAGGTCTCTTGGGAATATCCCGACACTTGGAGCACACCCC

ACAGCTACTTCTCTTTAACCTTTTGTGTGCAAGTTCAAGGTAAAAGCAA

GCGGGAGAAGAAAGACCGGGTGTTTACCGACAAAACCAGCGCCACCGTC

ATCTGTCGGAAGAACGCCTCCATCAGCGTGAGGGCTCAAGATCGTTATT

ACTCCAGCAGCTGGTCCGAGTGGGCCAGCGTGCCTTGTTCCGGCGGTGG

AGGATCCGGAGGAGGTGGCTCCGGCGGCGGAGGATCTCGTAACCTCCCC

GTGGCTACCCCCGATCCCGGAATGTTCCCTTGTTTACACCACAGCCAGA

ATTTACTGAGGGCCGTGAGCAACATGCTGCAGAAAGCTAGGCAGACTTT

AGAATTTTACCCTTGCACCAGCGAGGAGATCGACCATGAAGATATCACC

AAGGACAAGACATCCACCGTGGAGGCTTGTTTACCTCTGGAGCTGACAA

AGAACGAGTCTTGTCTCAACTCTCGTGAAACCAGCTTCATCACAAATGG

CTCTTGTTTAGCTTCCCGGAAGACCTCCTTTATGATGGCTTTATGCCTC

AGCTCCATCTACGAGGATTTAAAGATGTACCAAGTGGAGTTCAAGACCA

TGAACGCCAAGCTGCTCATGGACCCTAAACGGCAGATCTTTTTAGACCA

GAACATGCTGGCTGTGATTGATGAGCTGATGCAAGCTTTAAACTTCAAC

TCCGAGACCGTCCCTCAGAAGTCCTCCCTCGAGGAGCCCGATTTTTACA

AGACAAAGATCAAACTGTGCATTTTACTCCACGCCTTTAGGATCCGGGC

CGTGACCATTGACCGGGTCATGAGCTATTTAAACGCCAGCATTACATGC

CCCCCTCCCATGAGCGTGGAGCACGCCGACATCTGGGTGAAGAGCTATA

GCCTCTACAGCCGGGAGAGGTATATCTGTAACAGCGGCTTCAAGAGGAA

GGCCGGCACCAGCAGCCTCACCGAGTGCGTGCTGAATAAGGCTACCAAC

GTGGCTCACTGGACAACACCCTCTTTAAAGTGCATCCGG.
```

Exemplary Multi-Chain Chimeric Polypeptides—Type B

In some embodiments of any of the multi-chain chimeric polypeptides described herein, the first target-binding domain and the second targeting-binding domain each independently bind specifically to a receptor of IL-21 or to TGF-β. In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, one or both of the first target-binding domain and the second target-binding domain is a soluble IL-21 (e.g., a soluble human IL-21 polypeptide) or a soluble TGF-β receptor (e.g., a soluble TGFβRII receptor). In some embodiments of these multi-chain chimeric polypeptides, the first target-binding domain and the second target-binding domain are each independently a soluble IL-21 or a soluble TGF-β receptor (e.g., a soluble TGFβRII receptor). In some embodiments of these multi-chain chimeric polypeptides, the first target-binding domain and the second target-binding domain both bind specifically to a receptor of IL-21 or to TGF-β. In some embodiments of these multi-chain chimeric polypeptides, the first target-binding domain and the second target-binding domain bind specifically to the same epitope. In some embodiments of these multi-chain chimeric polypeptides, the first target-binding domain and the second target-binding domain include the same amino acid sequence.

In some embodiments of these multi-chain chimeric polypeptides, the first target-binding domain binds specifically to a receptor for IL-21, and the second target-binding domain binds specifically to TGF-β. In some embodiments of these multi-chain chimeric polypeptides, the first target-binding domain binds specifically to TGF-β, and the second target-binding domain bind specifically to a receptor for IL-21.

In some embodiments of these multi-chain chimeric polypeptides, the first target-binding domain includes a soluble IL-21 (e.g., a soluble human IL-21). In some embodiments of these multi-chain chimeric polypeptides, the soluble human IL-21 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 83)
LKSANTGNNERIINVSIKKLKRKPPSTNAGRRQKHRLTCPSCDSYEKKP

PKEFLERQGQDRHMIRMRQLIDIVDQLKNYVNDLVPEFLPAPEDVETNC

EWSAFSCFQKAQFKSLLQKMIHQHLSSRTHGSEDS.

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 182)
ACCAGCTGAAGAACTACGTGAACGACCTGGTGCCCGAGTTTCTGCCTGC

CCCCAGGGCCAGGACAGGCACATGATCCGGATGAGGCAGCTCATCGACA

TCGTCGCGAGGACGTGGAGACCAACTGCGAGTGGTCCGCCTTCTCCTGC

TTTCAGAAGGCCCAGCTGAAGTCCGCCAACACCGGCAACAACGAGCGGA

TCATCAACGTGAGCATCAAGAAGCTGAAGCGGAAGCCTCCCTCCACAAA

CGCCGGCAGGAGGCAGAAGCACAGGCTGACCTGCCCCAGCTGTGACTCC

TACGAGAAGAAGCCCCCCAAGGAGTTCCTGGAGAGGTTCAAGTCCCTGC

TGCAGAAGATGATCCATCAGCACCTGTCCTCCAGGACCCACGGCTCCGA

GGACTCC.

In some embodiments of these multi-chain chimeric polypeptides, the second target-binding domain includes a soluble TGF-β receptor (e.g., a soluble TGFRβRII receptor (e.g., a soluble human TGFRβRII receptor)). In some embodiments of these multi-chain chimeric polypeptides, the soluble human TGFRβRII includes a first sequence of soluble human TGFRβRII and a second sequence of soluble human TGFRβRII. In some embodiments of these multi-chain chimeric polypeptides, the soluble human TGFRβRII includes a linker disposed between the first sequence of soluble human TGFRβRII and the second sequence of soluble human TGFRβRII. In some examples of these multi-chain chimeric polypeptides, the linker includes the sequence GGGGSGGGGSGGGGS (SEQ ID NO: 102).

In some embodiments of these multi-chain chimeric polypeptides, the first sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 183)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPD.

In some embodiments of these multi-chain chimeric polypeptides, the second sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 184)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPD.

In some embodiments of these multi-chain chimeric polypeptides, the first sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 185)
AGCACCTGCGATAATCAGAAGTCCTGCATGTCCAACTGCACGATCACCT

CCAATCCCCCCCCATGTGCAAAAGAGCGTGAACAACGATATGATCGTGA

CCGACAACAACGGCGCCGTGAAGTTTCCCCAGCTCTGCAAGTTCTGCGA

TGTCAGGTTCTCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGAAAGCCCGGAGAGACCTTCTTTATGTGTTCCTGTA

GCAGCGACGAGTGTAACGCTTCATTCTGGAGGACGCTGCCTCCCCCAAA

TGCATCATGAAGGAGAAGAAGACAACATCATCTTCAGCGAAGAGTACAA

CACCAGCAACCCTGAT.

In some embodiments of these multi-chain chimeric polypeptides, the second sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 186)
ATTCCTCCCCACGTGCAGAAGAGCGTGAATAATGACATGATCGTGACCG

ATAACAATGGCGCCGTGAAATTTCCCCAGCTGTGCAAATTCTGCGATGT

GAGGTTTTCCACCTGCGACAACCAGAAGTCCTGTATGAGCAACTGCACA

ATCACCTCCATCTGTGAGAAGCCTCAGGAGGTGTGCGTGGCTGTCTGGC

GGAAGAATGACGAGAATATCACCCTGGAAACCGTCTGCCACGATCCCAA

GCTGCCCTACCACGATTTCATCCTGGAAGACGCCGCCAGCCCTAAGTGC

ATCATGAAAGAGAAAAAGAAGCCTGGCGAGACCTTTTTCATGTGCTCCT

GCAGCAGCGACGAATGCAACGACAATATCATCTTTAGCGAGGAATACAA

TACCAGCAACCCCGAC.

In some embodiments of these multi-chain chimeric polypeptides, the soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 187)
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCACG

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCCAAATGC

ATCATGAAGGAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGATGGAGGTGGCGGATCCGGAGGTGGAGGTTCTGGT

GGAGGTGGGAGTATTCCTCCCCACGTGCAGAAGAGCGTGAATAATGACA

TGATCGTGACCGATAACAATGGCGCCGTGAAATTTCCCCAGCTGTGCAA

ATTCTGCGATGTGAGGTTTTCCACCTGCGACAACCAGAAGTCCTGTATG

AGCAACTGCACAATCACCTCCATCTGTGAGAAGCCTCAGGAGGTGTGCG

TGGCTGTCTGGCGGAAGAATGACGAGAATATCACCCTGGAAACCGTCTG

CCACGATCCCAAGCTGCCCTACCACGATTTCATCCTGGAAGACGCCGCC

AGCCCTAAGTGCATCATGAAAGAGAAAAAGAAGCCTGGCGAGACCTTTT

TCATGTGCTCCTGCAGCAGCGACGAATGCAACGACAATATCATCTTTAG

CGAGGAATACAATACCAGCAACCCCGAC.

In some embodiments of these multi-chain chimeric polypeptides, the human TGFβRII receptor includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 188)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPDGGGGSGGGGSG

GGGSIPPHVQKSVNNDMIVTDNNGAVKFPQLCKFCDVRFSTCDNQKSCM

SNCSITSICEKPQEVCVAVWRKNDENITLETVCHDPKLPYHDFILEDAA

SPKCIMKEKKKPGETFFMCSCSSDECNDNIIFSEEYNTSNPD.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or (SEQ ID NO: 189)
QGQDRHMIRMRQLIDIVDQLKNYVNDLVPEFLPAPEDVETNCEWSAFSC

FQKAQLKSANTGNNERIINVSIKKLKRKPPSTNAGRRQKHRLTCPSCDS

YEKKPPKEFLERFKSLLQKMIHQHLSSRTHGSEDSSGTTNTVAAYNLTW

KSTNFKTILEWEPKPVNQVYTVQISTKSGDWKSKCFYTTDTECDLTDEI

VKDVKQTYLARVFSYPAGNVESTGSAGEPLYENSPEFTPYLETNLGQPT

IQSFEQVGTKVNVTVEDERTLVRRNNTFLSVNRKSTDSPVECMGQEKGE

FRENWVNVISDLKKIEDLIQSMHIDATLYTESDVHPLRDVFGKDLIYTL

YYWKSSSSGKKTAKTNTNEFLIDVDKGENYCFSVQAVIPSRTSCKVTAM

KCFLLELQVISLESGDASIHDTVENLIILANNSLSSNGNVTESGCKECE

ELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 190)
CAGGGCCAGGACAGGCACATGATCCGGATGAGGCAGCTCATCGACATCG

TCGCGAGGACGTGGAGACCAACTGCGAGTGGTCCGCCTTCTCCTGCTTT

CAGAAGGCCCAGCTGAAGTCCGCCAACACCGGCAACAACGAGCGGATCA

TCAACGTGACCAGCTGAAGAACTACGTGAACGACCTGGTGCCCGAGTTT

CTGCCTGCCCCAGCATCAAGAAGCTGAAGCGGAAGCCTCCCTCCACAAA

CGCCGGCAGGAGGCAGAAGCACAGGCTGACCTGCCCCAGCTGTGACTCC

TACGAGAAGAAGCCCCCCAAGGAGTTCCTGGAGAGGTTCAAGTCCCTGC

TGCAGAAGATGATCCATCAGCACCTGTCCTCCAGGACCCACGGCTCCGA

GGACTCCTCCGGCACCACCAATACCGTGGCCGCTTATAACCTCACATGG

AAGAGCACCAACTTCAAGACAATTCTGGAATGGGAACCCAAGCCCGTCA

ATCAAGTTTACACCGTGCAGATCTCCACCAAATCCGGAGACTGGAAGAG

CAAGTGCTTCTACACAACAGACACCGAGTGTGATTTAACCGACGAAATC

GTCAAGGACGTCAAGCAAACCTATCTGGCTCGGGTCTTTTCCTACCCCG

CTGGCAATGTCGAGTCCACCGGCTCCGCTGGCGAGCCTCTCTACGAGAA

TTCCCCCGAATTCACCCCTTATTTAGAGACCAATTTAGGCCAGCCTACC

ATCCAGAGCTTCGAGCAAGTTGGCACCAAGGTGAACGTCACCGTCGAGG

ATGAAAGGACTTTAGTGCGGCGGAATAACACATTTTTATCCCTCCGGGA

TGTGTTCGGCAAAGACCTCATCTACACACTGTACTATTGGAAGTCCAGC

TCCTCCGGCAAAAAGACCGCTAAGACCAACACCAACGAGTTTTTAATTG

ACGTGGACAAAGGCGAGAACTACTGCTTCAGCGTGCAAGCCGTGATCCC

TTCTCGTACCGTCAACCGGAAGAGCACAGATTCCCCCGTTGAGTGCATG

GGCCAAGAAAAGGGCGAGTTCCGGGAGAACTGGGTGAACGTCATCAGCG

ATTTAAAGAAGATCGAAGATTTAATTCAGTCCATGCATATCGACGCCAC

TTTATACACAGAATCCGACGTGCACCCCTCTTGTAAGGTGACCGCCATG

AAATGTTTTTTACTGGAGCTGCAAGTTATCTCTTTAGAGAGCGGAGACG

CTAGCATCCACGACACCGTGGAGAATTTAATCATTTTAGCCAATAACTC

TTTATCCAGCAACGGCAACGTGACAGAGTCCGGCTGCAAGGAGTGCGAA

GAGCTGGAGGAGAAGAACATCAAGGAGTTTCTGCAATCCTTTGTGCACA

TTGTCCAGATGTTCATCAATACCTCC.

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 191)
MKWVTFISLLFLFSSAYSQGQDRHMIRMRQLIDIVDQLKNYVNDLVPEF

LPAPEDVETNCEWSAFSCFQKAQLKSANTGNNERIINVSIKKLKRKPPS

TNAGRRQKHRLTCPSCDSYEKKPPKEFLERFKSLLQKMIHQHLSSRTHG

SEDSSGTTNTVAAYNLTWKSTNFKTILEWEPKPVNQVYTVQISTKSGDW

KSKCFYTTDTECDLTDEIVKDVKQTYLARVFSYPAGNVESTGSAGEPLY

ENSPEFTPYLETNLGQPTIQSFEQVGTKVNVTVEDERTLVRRNNTFLSL

RDVFGKDLIYTLYYWKSSSSGKKTAKTNTNEFLIDVDKGENYCFSVQAV

IPSRTVNRKSTDSPVECMGQEKGEFRENWVNVISDLKKIEDLIQSMHID

ATLYTESDVHPSCKVTAMKCFLLELQVISLESGDASIHDTVENLIILAN

NSLSSNGNVTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 192)
ATGAAGTGGGTGACCTTCATCAGCCTGCTGTTCCTGTTCTCCAGCGCCT

ACTCCCAGGGCCAGGACAGGCACATGATCCGGATGAGGCAGCTCATCGA

CATCGTCGACCAGCTGAAGAACTACGTGAACGACCTGGTGCCCGAGTTT

CTGCCTGCCCCCGAGGACGTGGAGACCAACTGCGAGTGGTCCGCCTTCT

CCTGCTTTCAGAAGGCCCAGCTGAAGTCCGCCAACACCGGCAACAACGA

GCGGATCATCAACGTGAGCATCAAGAAGCTGAAGCGGAAGCCTCCCTCC

ACAAACGCCGGCAGGAGGCAGAAGCACAGGCTGACCTGCCCCAGCTGTG

ACTCCTACGAGAAGAAGCCCCCCAAGGAGTTCCTGGAGAGGTTCAAGTC

CCTGCTGCAGAAGATGATCCATCAGCACCTGTCCTCCAGGACCCACGGC

TCCGAGGACTCCTCCGGCACCACCAATACCGTGGCCGCTTATAACCTCA

CATGGAAGAGCACCAACTTCAAGACAATTCTGGAATGGGAACCCAAGCC

CGTCAATCAAGTTTACACCGTGCAGATCTCCACCAAATCCGGAGACTGG

AAGAGCAAGTGCTTCTACACAACAGACACCGAGTGTGATTTAACCGACG

AAATCGTCAAGGACGTCAAGCAAACCTATCTGGCTCGGGTCTTTTCCTA

CCCCGCTGGCAATGTCGAGTCCACCGGCTCCGCTGGCGAGCCTCTCTAC

GAGAATTCCCCCGAATTCACCCCTTATTTAGAGACCAATTTAGGCCAGC

CTACCATCCAGAGCTTCGAGCAAGTTGGCACCAAGGTGAACGTCACCGT

CGAGGATGAAAGGACTTTAGTGCGGCGGAATAACACATTTTTATCCCTC

CGGGATGTGTTCGGCAAAGACCTCATCTACACACTGTACTATTGGAAGT

CCAGCTCCTCCGGCAAAAAGACCGCTAAGACCAACACCAACGAGTTTTT

AATTGACGTGGACAAAGGCGAGAACTACTGCTTCAGCGTGCAAGCCGTG

ATCCCTTCTCGTACCGTCAACCGGAAGAGCACAGATTCCCCCGTTGAGT

GCATGGGCCAAGAAAAGGGCGAGTTCCGGGAGAACTGGGTGAACGTCAT

CAGCGATTTAAAGAAGATCGAAGATTTAATTCAGTCCATGCATATCGAC

GCCACTTTATACACAGAATCCGACGTGCACCCCTCTTGTAAGGTGACCG

CCATGAAATGTTTTTTACTGGAGCTGCAAGTTATCTCTTTAGAGAGCGG

AGACGCTAGCATCCACGACACCGTGGAGAATTTAATCATTTTAGCCAAT

AACTCTTTATCCAGCAACGGCAACGTGACAGAGTCCGGCTGCAAGGAGT

GCGAAGAGCTGGAGGAGAAGAACATCAAGGAGTTTCTGCAATCCTTTGT

GCACATTGTCCAGATGTTCATCAATACCTCC.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 193)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPDGGGGSGGGGSG

GGGSIPPHVQKSVNNDMIVTDNNGAVKFPQLCKFCDVRFSTCDNQKSCM

SNCSITSICEKPQEVCVAVWRKNDENITLETVCHDPKLPYHDFILEDAA

SPKCIMKEKKKPGETFFMCSCSSDECNDNIIFSEEYNTSNPDITCPPPM

SVEHADIWVKSYSLYSRERYICNSGFKRKAGTSSLTECVLNKATNVAHW

TTPSLKCIR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 194)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCACGATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

-continued
```
CGATAACAATGGCGCCGTGAAATTTCCCCAGCTGTGCAAATTCTGCGATG

TGAGGTTTTCCACCTGCGACAACCAGAAGTCCTGTATGAGCAACTGCACA

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGACATCACGTGTCCTCCTCCTATGTCCGTGGAACACGCAGAC

ATCTGGGTCAAGAGCTACAGCTTGTACTCCAGGGAGCGGTACATTTGTAA

CTCTGGTTTCAAGCGTAAAGCCGGCACGTCCAGCCTGACGGAGTGCGTGT

TGAACAAGGCCACGAATGTCGCCCACTGGACAACCCCCAGTCTCAAATGT

ATTAGA.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                        (SEQ ID NO: 195)
MKWVTFISLLFLFSSAYSIPPHVQKSVNNDMIVTDNNGAVKFPQLCKFCD

VRFSTCDNQKSCMSNCSITSICEKPQEVCVAVWRKNDENITLETVCHDPK

LPYHDFILEDAASPKCIMKEKKKPGETFFMCSCSSDECNDNIIFSEEYNT

SNPDGGGGSGGGGSGGGGSIPPHVQKSVNNDMIVTDNNGAVKFPQLCKFC

DVRFSTCDNQKSCMSNCSITSICEKPQEVCVAVWRKNDENITLETVCHDP

KLPYHDFILEDAASPKCIMKEKKKPGETFFMCSCSSDECNDNIIFSEEYN

TSNPDITCPPPMSVEHADIWVKSYSLYSRERYICNSGFKRKAGTSSLTEC

VLNKATNVAHWTTPSLKCIR.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                        (SEQ ID NO: 196)
ATGAAGTGGGTGACCTTCATCAGCCTGCTGTTCCTGTTCTCCAGCGCCTA

CTCCATCCCCCCCCATGTGCAAAAGAGCGTGAACAACGATATGATCGTGA

CCGACAACAACGGCGCCGTGAAGTTTCCCCAGCTCTGCAAGTTCTGCGAT

GTCAGGTTCAGCACCTGCGATAATCAGAAGTCCTGCATGTCCAACTGCAC

GATCACCTCCATCTGCGAGAAGCCCCAAGAAGTGTGCGTGGCCGTGTGGC

GGAAAAATGACGAGAACATCACCCTGGAGACCGTGTGTCACGACCCCAAG

CTCCCTTATCACGACTTCATTCTGGAGGACGCTGCCTCCCCCAAATGCAT

CATGAAGGAGAAGAAGAAGCCCGGAGAGACCTTCTTTATGTGTTCCTGTA

GCAGCGACGAGTGTAACGACAACATCATCTTCAGCGAAGAGTACAACACC

AGCAACCCTGATGGAGGTGGCGGATCCGGAGGTGGAGGTTCTGGTGGAGG

TGGGAGTATTCCTCCCCACGTGCAGAAGAGCGTGAATAATGACATGATCG

TGACCGATAACAATGGCGCCGTGAAATTTCCCCAGCTGTGCAAATTCTGC

GATGTGAGGTTTTCCACCTGCGACAACCAGAAGTCCTGTATGAGCAACTG

CACAATCACCTCCATCTGTGAGAAGCCTCAGGAGGTGTGCGTGGCTGTCT

GGCGGAAGAATGACGAGAATATCACCCTGGAAACCGTCTGCCACGATCCC

AAGCTGCCCTACCACGATTTCATCCTGGAAGACGCCGCCAGCCCTAAGTG

CATCATGAAAGAGAAAAAGAAGCCTGGCGAGACCTTTTTCATGTGCTCCT

GCAGCAGCGACGAATGCAACGACAATATCATCTTTAGCGAGGAATACAAT

ACCAGCAACCCCGACATCACGTGTCCTCCTCCTATGTCCGTGGAACACGC

AGACATCTGGGTCAAGAGCTACAGCTTGTACTCCAGGGAGCGGTACATTT

GTAACTCTGGTTTCAAGCGTAAAGCCGGCACGTCCAGCCTGACGGAGTGC

GTGTTGAACAAGGCCACGAATGTCGCCCACTGGACAACCCCCCTCAAATG

TATTAGA.
```

Exemplary Multi-Chain Chimeric Polypeptides—Type C

In some embodiments of any of the multi-chain chimeric polypeptides described herein, the first target-binding domain and the second targeting-binding domain each independently bind specifically to a receptor of IL-7 or a receptor of IL-21. In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, one or both of the first target-binding domain and the second target-binding domain is a soluble IL-21 (e.g., a soluble human IL-21 polypeptide) or a soluble IL-7 (e.g., a soluble human IL-7 polypeptide). In some embodiments of these multi-chain chimeric polypeptides, the first target-binding domain and the second target-binding domain are each independently a soluble IL-21 or a soluble IL-7. In some embodiments of these multi-chain chimeric polypeptides, the first target-binding domain and the second target-binding domain both bind specifically to a receptor of IL-21 or a receptor of IL-7. In some embodiments of these multi-chain chimeric polypeptides, the first target-binding domain and the second target-binding domain bind specifically to the same epitope. In some embodiments of these multi-chain chimeric polypeptides, the first target-binding domain and the second target-binding domain include the same amino acid sequence.

In some embodiments of these multi-chain chimeric polypeptides, the first target-binding domain binds specifically to a receptor for IL-21, and the second target-binding domain binds specifically to a receptor for IL-7. In some embodiments of these multi-chain chimeric polypeptides, the first target-binding domain binds specifically to a receptor for IL-7, and the second target-binding domain binds specifically to a receptor for IL-21.

In some embodiments of these multi-chain chimeric polypeptides, the first target-binding domain includes a soluble IL-21 (e.g., a soluble human IL-21).

In some embodiments of these multi-chain chimeric polypeptides, the soluble human IL-21 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 83)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS.

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 197)
CAAGGTCAAGATCGCCACATGATTAGAATGCGTCAACTTATAGATATTGT

TGATCAGCTGAAAAATTATGTGAATGACTTGGTCCCTGAATTTCTGCCAG

CTCCAGAAGATGTAGAGACAAACTGTGAGTGGTCAGCTTTTTCCTGTTTT

CAGAAGGCCCAACTAAAGTCAGCAAATACAGGAAACAATGAAAGGATAAT

CAATGTATCAATTAAAAAGCTGAAGAGGAAACCACCTTCCACAAATGCAG

GGAGAAGACAGAAACACAGACTAACATGCCCTTCATGTGATTCTTATGAG

AAAAAACCACCCAAAGAATTCCTAGAAAGATTCAAATCACTTCTCCAAAA

GATGATTCATCAGCATCTGTCCTCTAGAACACACGGAAGTGAAGATTCC.

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 182)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCCAAGGAGTTCCTGGAGAGGTTCAAGTCCCTGCTGCAGAA

GATGATCCATCAGCACCTGTCCTCCAGGACCCACGGCTCCGAGGACTCC.

In some embodiments of these multi-chain chimeric polypeptides, the sequence of soluble human IL-7 comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 79)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EH.

In some embodiments of these multi-chain chimeric polypeptides, the soluble human IL-7 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 198)
GATTGTGATATTGAAGGTAAAGATGGCAAACAATATGAGAGTGTTCTAAT

GGTCAGCATCGATCAATTATTGGACAGCATGAAAGAAATTGGTAGCAATT

GCCTGAATAATGAATTTAACTTTTTTAAAAGACATATCTGTGATGCTAAT

AAGGAAGGTATGTTTTTATTCCGTGCTGCTCGCAAGTTGAGGCAATTTCT

TAAAATGAATAGCACTGGTGATTTTGATCTCCACTTATTAAAAGTTTCAG

AAGGCACAACAATACTGTTGAACTGCACTGGCCAGGTTAAAGGAAGAAAA

CCAGCTGCCCTGGGTGAAGCCCAACCAACAAAGAGTTTGGAAGAAAATAA

ATCTTTAAAGGAACAGAAAAAACTGAATGACTTGTGTTTCCTAAAGAGAC

TATTACAAGAGATAAAAACTTGTTGGAATAAAATTTTGATGGGCACTAAA

GAACAC.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 199)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDSSGTTNTVAAYNLTWKST

NFKTILEWEPKPVNQVYTVQISTKSGDWKSKCFYTTDTECDLTDEIVKDV

KQTYLARVFSYPAGNVESTGSAGEPLYENSPEFTPYLETNLGQPTIQSFE

QVGTKVNVTVEDERTLVRRNNTFLSLRDVFGKDLIYTLYYWKSSSSGKKT

AKTNTNEFLIDVDKGENYCFSVQAVIPSRTVNRKSTDSPVECMGQEKGEF

RENWVNVISDLKKIEDLIQSMHIDATLYTESDVHPSCKVTAMKCFLLELQ

VISLESGDASIHDTVENLIILANNSLSSNGNVTESGCKECEELEEKNIKE

FLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 200)
CAAGGTCAAGATCGCCACATGATTAGAATGCGTCAACTTATAGATATTGT

TGATCAGCTGAAAAATTATGTGAATGACTTGGTCCCTGAATTTCTGCCAG

CTCCAGAAGATGTAGAGACAAACTGTGAGTGGTCAGCTTTTTCCTGTTTT

CAGAAGGCCCAACTAAAGTCAGCAAATACAGGAAACAATGAAAGGATAAT

CAATGTATCAATTAAAAAGCTGAAGAGGAAACCACCTTCCACAAATGCAG

GGAGAAGACAGAAACACAGACTAACATGCCCTTCATGTGATTCTTATGAG

AAAAAACCACCCAAAGAATTCCTAGAAAGATTCAAATCACTTCTCCAAAA

GATGATTCATCAGCATCTGTCCTCTAGAACACACGGAAGTGAAGATTCCT

CAGGCACTACAAATACTGTGGCAGCATATAATTTAACTTGGAAATCAACT

AATTTCAAGACAATTTTGGAGTGGGAACCCAAACCCGTCAATCAAGTCTA

CACTGTTCAAATAAGCACTAAGTCAGGAGATTGGAAAAGCAAATGCTTTT

ACACAACAGACACAGAGTGTGACCTCACCGACGAGATTGTGAAGGATGTG

AAGCAGACGTACTTGGCACGGGTCTTCTCCTACCCGGCAGGGAATGTGGA

GAGCACCGGTTCTGCTGGGGAGCCTCTGTATGAGAACTCCCCAGAGTTCA

CACCTTACCTGGAGACAAACCTCGGACAGCCAACAATTCAGAGTTTTGAA

CAGGTGGGAACAAAAGTGAATGTGACCGTAGAAGATGAACGGACTTTAGT

CAGAAGGAACAACACTTTCCTAAGCCTCCGGGATGTTTTGGCAAGGACT

TAATTTATACACTTTATTATTGGAAATCTTCAAGTTCAGGAAAGAAAACA

GCCAAAACAAACACTAATGAGTTTTTGATTGATGTGGATAAAGGAGAAAA

CTACTGTTTCAGTGTTCAAGCAGTGATTCCCTCCCGAACAGTTAACCGGA

AGAGTACAGACAGCCCGGTAGAGTGTATGGGCCAGGAGAAAGGGGAATTC

AGAGAAAACTGGGTGAACGTCATCAGCGATTTAAAGAAGATCGAAGATTT

AATTCAGTCCATGCATATCGACGCCACTTTATACACAGAATCCGACGTGC

ACCCCTCTTGTAAGGTGACCGCCATGAAATGTTTTTTACTGGAGCTGCAA

GTTATCTCTTTAGAGAGCGGAGACGCTAGCATCCACGACACCGTGGAGAA

TTTAATCATTTTAGCCAATAACTCTTTATCCAGCAACGGCAACGTGACAG

AGTCCGGCTGCAAGGAGTGCGAAGAGCTGGAGGAGAAGAACATCAAGGAG

TTTCTGCAATCCTTTGTGCACATTGTCCAGATGTTCATCAATACCTCC.

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 201)
MGVKVLFALICIAVAEAQGQDRHMIRMRQLIDIVDQLKNYVNDLVPEFLP

APEDVETNCEWSAFSCFQKAQLKSANTGNNERIINVSIKKLKRKPPSTNA

GRRQKHRLTCPSCDSYEKKPPKEFLERFKSLLQKMIHQHLSSRTHGSEDS

SGTTNTVAAYNLTWKSTNFKTILEWEPKPVNQVYTVQISTKSGDWKSKCF

YTTDTECDLTDEIVKDVKQTYLARVFSYPAGNVESTGSAGEPLYENSPEF

TPYLETNLGQPTIQSFEQVGTKVNVTVEDERTLVRRNNTFLSLRDVFGKD

LIYTLYYWKSSSSGKKTAKTNTNEFLIDVDKGENYCFSVQAVIPSRTVNR

KSTDSPVECMGQEKGEFRENWVNVISDLKKIEDLIQSMHIDATLYTESDV

HPSCKVTAMKCFLLELQVISLESGDASIHDTVENLIILANNSLSSNGNVT

ESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 202)
ATGGGAGTGAAAGTTCTTTTTGCCCTTATTTGTATTGCTGTGGCCGAGGC

CCAAGGTCAAGATCGCCACATGATTAGAATGCGTCAACTTATAGATATTG

TTGATCAGCTGAAAAATTATGTGAATGACTTGGTCCCTGAATTTCTGCCA

GCTCCAGAAGATGTAGAGACAAACTGTGAGTGGTCAGCTTTTTCCTGTTT

TCAGAAGGCCCAACTAAAGTCAGCAAATACAGGAAACAATGAAAGGATAA

TCAATGTATCAATTAAAAAGCTGAAGAGGAAACCACCTTCCACAAATGCA

GGGAGAAGACAGAAACACAGACTAACATGCCCTTCATGTGATTCTTATGA

GAAAAAACCACCCAAAGAATTCCTAGAAAGATTCAAATCACTTCTCCAAA

AGATGATTCATCAGCATCTGTCCTCTAGAACACACGGAAGTGAAGATTCC

TCAGGCACTACAAATACTGTGGCAGCATATAATTTAACTTGGAAATCAAC

TAATTTCAAGACAATTTTGGAGTGGGAACCCAAACCCGTCAATCAAGTCT

ACACTGTTCAAATAAGCACTAAGTCAGGAGATTGGAAAAGCAAATGCTTT

```
TACACAACAGACACAGAGTGTGACCTCACCGACGAGATTGTGAAGGATGT

GAAGCAGACGTACTTGGCACGGGTCTTCTCCTACCCGGCAGGGAATGTGG

AGAGCACCGGTTCTGCTGGGGAGCCTCTGTATGAGAACTCCCCAGAGTTC

ACACCTTACCTGGAGACAAACCTCGGACAGCCAACAATTCAGAGTTTTGA

ACAGGTGGGAACAAAAGTGAATGTGACCGTAGAAGATGAACGGACTTTAG

TCAGAAGGAACAACACTTTCCTAAGCCTCCGGGATGTTTTTGGCAAGGAC

TTAATTTATACACTTTATTATTGGAAATCTTCAAGTTCAGGAAAGAAAAC

AGCCAAAACAAACACTAATGAGTTTTTGATTGATGTGGATAAAGGAGAAA

ACTACTGTTTCAGTGTTCAAGCAGTGATTCCCTCCCGAACAGTTAACCGG

AAGAGTACAGACAGCCCGGTAGAGTGTATGGGCCAGGAGAAAGGGGAATT

CAGAGAAAACTGGGTGAACGTCATCAGCGATTTAAAGAAGATCGAAGATT

TAATTCAGTCCATGCATATCGACGCCACTTTATACACAGAATCCGACGTG

CACCCCTCTTGTAAGGTGACCGCCATGAAATGTTTTTTACTGGAGCTGCA

AGTTATCTCTTTAGAGAGCGGAGACGCTAGCATCCACGACACCGTGGAGA

ATTTAATCATTTTAGCCAATAACTCTTTATCCAGCAACGGCAACGTGACA

GAGTCCGGCTGCAAGGAGTGCGAAGAGCTGGAGGAGAAGAACATCAAGGA

GTTTCTGCAATCCTTTGTGCACATTGTCCAGATGTTCATCAATACCTCC
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                        (SEQ ID NO: 203)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EHITCPPPMSVEHADIWVKSYSLYSRERYICNSGFKRKAGTSSLTECVLN

KATNVAHWTTPSLKCIR
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                        (SEQ ID NO: 204)
GATTGTGATATTGAAGGTAAAGATGGCAAACAATATGAGAGTGTTCTAAT

GGTCAGCATCGATCAATTATTGGACAGCATGAAAGAAATTGGTAGCAATT

GCCTGAATAATGAATTTAACTTTTTTAAAAGACATATCTGTGATGCTAAT

AAGGAAGGTATGTTTTTATTCCGTGCTGCTCGCAAGTTGAGGCAATTTCT

TAAAATGAATAGCACTGGTGATTTTGATCTCCACTTATTAAAAGTTTCAG

AAGGCACAACAATACTGTTGAACTGCACTGGCCAGGTTAAAGGAAGAAA

CCAGCTGCCCTGGGTGAAGCCCAACCAACAAAGAGTTTGGAAGAAAATAA

ATCTTTAAAGGAACAGAAAAAACTGAATGACTTGTGTTTCCTAAAGAGAC

TATTACAAGAGATAAAAACTTGTTGGAATAAAATTTTGATGGGCACTAAA

GAACACATCACGTGCCCTCCCCCCATGTCCGTGGAACACGCAGACATCTG

GGTCAAGAGCTACAGCTTGTACTCCAGGGAGCGGTACATTTGTAACTCTG

GTTTCAAGCGTAAAGCCGGCACGTCCAGCCTGACGGAGTGCGTGTTGAAC

AAGGCCACGAATGTCGCCCACTGGACAACCCCCAGTCTCAAATGCATTAG

A.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                        (SEQ ID NO: 205)
MGVKVLFALICIAVAEADCDIEGKDGKQYESVLMVSIDQLLDSMKEIGSN

CLNNEFNFFKRHICDANKEGMFLFRAARKLRQFLKMNSTGDFDLHLLKVS

EGTTILLNCTGQVKGRKPAALGEAQPTKSLEENKSLKEQKKLNDLCFLKR

LLQEIKTCWNKILMGTKEHITCPPPMSVEHADIWVKSYSLYSRERYICNS

GFKRKAGTSSLTECVLNKATNVAHWTTPSLKCIR.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                        (SEQ ID NO: 206)
ATGGGAGTGAAAGTTCTTTTTGCCCTTATTTGTATTGCTGTGGCCGAGGC

CGATTGTGATATTGAAGGTAAAGATGGCAAACAATATGAGAGTGTTCTAA

TGGTCAGCATCGATCAATTATTGGACAGCATGAAAGAAATTGGTAGCAAT

TGCCTGAATAATGAATTTAACTTTTTTAAAAGACATATCTGTGATGCTAA

TAAGGAAGGTATGTTTTTATTCCGTGCTGCTCGCAAGTTGAGGCAATTTC

TTAAAATGAATAGCACTGGTGATTTTGATCTCCACTTATTAAAAGTTTCA

GAAGGCACAACAATACTGTTGAACTGCACTGGCCAGGTTAAAGGAAGAAA

ACCAGCTGCCCTGGGTGAAGCCCAACCAACAAAGAGTTTGGAAGAAATA

AATCTTTAAAGGAACAGAAAAAACTGAATGACTTGTGTTTCCTAAAGAGA

CTATTACAAGAGATAAAAACTTGTTGGAATAAAATTTTGATGGGCACTAA

AGAACACATCACGTGCCCTCCCCCCATGTCCGTGGAACACGCAGACATCT

GGGTCAAGAGCTACAGCTTGTACTCCAGGGAGCGGTACATTTGTAACTCT

GGTTTCAAGCGTAAAGCCGGCACGTCCAGCCTGACGGAGTGCGTGTTGAA

CAAGGCCACGAATGTCGCCCACTGGACAACCCCCAGTCTCAAATGCATTA

GA.
```

Exemplary Multi-Chain Chimeric Polypeptides—Type D

In some embodiments of any of the multi-chain chimeric polypeptides described herein, the first target-binding domain and the second targeting-binding domain each independently bind specifically to a receptor of IL-7 or a receptor of IL-21. In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, one or both of the first target-binding domain and the second target-binding domain is a soluble IL-21 (e.g., a soluble human IL-21 polypeptide) or a soluble IL-7 (e.g., a soluble human IL-7 polypeptide). In some embodiments of these multi-chain chimeric polypeptides, the first target-binding domain and the second target-binding domain are each independently a soluble IL-21 or a soluble IL-7. In some embodiments of these multi-chain chimeric polypeptides, the first target-binding domain and the second target-binding domain both bind specifically to a receptor of IL-21 or a receptor of IL-7. In some embodiments of these multi-chain chimeric polypeptides, the first target-binding domain and the second target-binding domain bind specifically to the same epitope. In some embodiments of these multi-chain chimeric polypeptides, the first target-binding domain and the second target-binding domain include the same amino acid sequence.

In some embodiments of these multi-chain chimeric polypeptides, the first target-binding domain binds specifically to a receptor for IL-21, and the second target-binding domain binds specifically to a receptor for IL-7. In some embodiments of these multi-chain chimeric polypeptides, the first target-binding domain binds specifically to a receptor for IL-7, and the second target-binding domain binds specifically to a receptor for IL-21.

In some embodiments of these multi-chain chimeric polypeptides, the soluble human IL-21 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
(SEQ ID NO: 83)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS.
```

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
(SEQ ID NO: 197)
CAAGGTCAAGATCGCCACATGATTAGAATGCGTCAACTTATAGATATTGT

TGATCAGCTGAAAAATTATGTGAATGACTTGGTCCCTGAATTTCTGCCAG

CTCCAGAAGATGTAGAGACAAACTGTGAGTGGTCAGCTTTTTCCTGTTTT

CAGAAGGCCCAACTAAAGTCAGCAAATACAGGAAACAATGAAAGGATAAT

CAATGTATCAATTAAAAAGCTGAAGAGGAAACCACCTTCCACAAATGCAG

GGAGAAGACAGAAACACAGACTAACATGCCCTTCATGTGATTCTTATGAG

AAAAAACCACCCAAAGAATTCCTAGAAAGATTCAAATCACTTCTCCAAAA

GATGATTCATCAGCATCTGTCCTCTAGAACACACGGAAGTGAAGATTCC.
```

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
(SEQ ID NO: 182)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCCAAGGAGTTCCTGGAGAGGTTCAAGTCCCTGCTGCAGAA

GATGATCCATCAGCACCTGTCCTCCAGGACCCACGGCTCCGAGGACTCC.
```

In some embodiments of these multi-chain chimeric polypeptides, the sequence of soluble human IL-7 comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 79)
DCDIEGKDGKQYESVLMVSIDQLLDSMKEIGSNCLNNEFNFFKRHICDAN
KEGMFLFRAARKLRQFLKMNSTGDFDLHLLKVSEGTTILLNCTGQVKGRK
PAALGEAQPTKSLEENKSLKEQKKLNDLCFLKRLLQEIKTCWNKILMGTK
EH.

In some embodiments of these multi-chain chimeric polypeptides, the soluble human IL-7 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 198)
GATTGTGATATTGAAGGTAAAGATGGCAAACAATATGAGAGTGTTCTAAT
GGTCAGCATCGATCAATTATTGGACAGCATGAAAGAAATTGGTAGCAATT
GCCTGAATAATGAATTTAACTTTTTTAAAAGACATATCTGTGATGCTAAT
AAGGAAGGTATGTTTTTATTCCGTGCTGCTCGCAAGTTGAGGCAATTTCT
TAAAATGAATAGCACTGGTGATTTTGATCTCCACTTATTAAAAGTTTCAG
AAGGCACAACAATACTGTTGAACTGCACTGGCCAGGTTAAAGGAAGAAAA
CCAGCTGCCCTGGGTGAAGCCCAACCAACAAAGAGTTTGGAAGAAAATAA
ATCTTTAAAGGAACAGAAAAAACTGAATGACTTGTGTTTCCTAAAGAGAC
TATTACAAGAGATAAAAACTTGTTGGAATAAAATTTTGATGGGCACTAAA
GAACAC.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 207)
DCDIEGKDGKQYESVLMVSIDQLLDSMKEIGSNCLNNEFNFFKRHICDAN
KEGMFLFRAARKLRQFLKMNSTGDFDLHLLKVSEGTTILLNCTGQVKGRK
PAALGEAQPTKSLEENKSLKEQKKLNDLCFLKRLLQEIKTCWNKILMGTK
EHSGTTNTVAAYNLTWKSTNFKTILEWEPKPVNQVYTVQISTKSGDWKSK
CFYTTDTECDLTDEIVKDVKQTYLARVFSYPAGNVESTGSAGEPLYENSP
EFTPYLETNLGQPTIQSFEQVGTKVNVTVEDERTLVRRNNTFLSLRDVFG
KDLIYTLYYWKSSSSGKKTAKTNTNEFLIDVDKGENYCFSVQAVIPSRTV
NRKSTDSPVECMGQEKGEFRENWVNVISDLKKIEDLIQSMHIDATLYTES
DVHPSCKVTAMKCFLLELQVISLESGDASIHDTVENLIILANNSLSSNGN
VTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 208)
GATTGCGACATCGAGGGCAAGGACGGCAAGCAGTACGAGAGCGTGCTGAT
GGTGTCCATCGACCAGCTGCTGGACAGCATGAAGGAGATCGGCTCCAACT
GCCTCAACAACGAGTTCAACTTCTTCAAGCGGCACATCTGCGACGCCAAC
AAGGAGGGCATGTTCCTGTTCAGGGCCGCCAGGAAACTGCGGCAGTTCCT
GAAGATGAACTCCACCGGCGACTTCGACCTGCACCTGCTGAAGGTGTCCG
AGGGCACCACCATCCTGCTGAACTGCACCGGACAGGTGAAGGGCCGGAAA
CCTGCTGCTCTGGGAGAGGCCCAACCCACCAAGAGCCTGGAGGAGAACAA
GTCCCTGAAGGAGCAGAAGAAGCTGAACGACCTGTGCTTCCTGAAGAGGC
TGCTGCAGGAGATCAAGACCTGCTGGAACAAGATCCTGATGGGCACCAAG
GAGCATAGCGGCACAACCAACACAGTCGCTGCCTATAACCTCACTTGGAA
GAGCACCAACTTCAAAACCATCCTCGAATGGGAACCCAAACCCGTTAACC
AAGTTTACACCGTGCAGATCAGCACCAAGTCCGGCGACTGGAAGTCCAAA
TGTTTCTATACCACCGACACCGAGTGCGATCTCACCGATGAGATCGTGAA
AGATGTGAAACAGACCTACCTCGCCCGGGTGTTTAGCTACCCCGCCGGCA
ATGTGGAGAGCACTGGTTCCGCTGGCGAGCCTTTATACGAGAACAGCCCC
GAATTTACCCCTTACCTCGAGACCAATTTAGGACAGCCCACCATCCAAAG
CTTTGAGCAAGTTGGCACAAAGGTGAATGTGACAGTGGAGGACGAGCGGA
CTTTAGTGCGGCGGAACAACACCTTTCTCAGCCTCCGGGATGTGTTCGGC
AAAGATTTAATCTACACACTGTATTACTGGAAGTCCTCTTCCTCCGGCAA
GAAGACAGCTAAAACCAACACAAACGAGTTTTTAATCGACGTGGATAAAG
GCGAAAACTACTGTTTCAGCGTGCAAGCTGTGATCCCCTCCCGGACCGTG
AATAGGAAAAGCACCGATAGCCCCGTTGAGTGCATGGGCCAAGAAAAGGG
CGAGTTCCGGGAGAACTGGGTGAACGTCATCAGCGATTTAAAGAAGATCG
AAGATTTAATTCAGTCCATGCATATCGACGCCACTTTATACACAGAATCC
GACGTGCACCCCTCTTGTAAGGTGACCGCCATGAAATGTTTTTTACTGGA
GCTGCAAGTTATCTCTTTAGAGAGCGGAGACGCTAGCATCCACGACACCG
TGGAGAATTTAATCATTTTAGCCAATAACTCTTTATCCAGCAACGGCAAC
GTGACAGAGTCCGGCTGCAAGGAGTGCGAAGAGCTGGAGGAGAAGAACAT
CAAGGAGTTTCTGCAATCCTTTGTGCACATTGTCCAGATGTTCATCAATA
CCTCC.

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 209)
MKWVTFISLLFLFSSAYSDCDIEGKDGKQYESVLMVSIDQLLDSMKEIGS
NCLNNEFNFFKRHICDANKEGMFLFRAARKLRQFLKMNSTGDFDLHLLKV
SEGTTILLNCTGQVKGRKPAALGEAQPTKSLEENKSLKEQKKLNDLCFLK
RLLQEIKTCWNKILMGTKEHSGTTNTVAAYNLTWKSTNFKTILEWEPKPV

-continued
NQVYTVQISTKSGDWKSKCFYTTDTECDLTDEIVKDVKQTYLARVFSYPA

GNVESTGSAGEPLYENSPEFTPYLETNLGQPTIQSFEQVGTKVNVTVEDE

RTLVRRNNTFLSLRDVFGKDLIYTLYYWKSSSSGKKTAKTNTNEFLIDVD

KGENYCFSVQAVIPSRTVNRKSTDSPVECMGQEKGEFRENWVNVISDLKK

IEDLIQSMHIDATLYTESDVHPSCKVTAMKCFLLELQVISLESGDASIHD

TVENLIILANNSLSSNGNVTESGCKECEELEEKNIKEFLQSFVHIVQMFI

NTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 210)
ATGAAGTGGGTGACCTTCATCAGCCTGCTGTTCCTGTTCTCCAGCGCCTA

CTCCGATTGCGACATCGAGGGCAAGGACGGCAAGCAGTACGAGAGCGTGC

TGATGGTGTCCATCGACCAGCTGCTGGACAGCATGAAGGAGATCGGCTCC

AACTGCCTCAACAACGAGTTCAACTTCTTCAAGCGGCACATCTGCGACGC

CAACAAGGAGGGCATGTTCCTGTTCAGGGCCGCCAGGAAACTGCGGCAGT

TCCTGAAGATGAACTCCACCGGCGACTTCGACCTGCACCTGCTGAAGGTG

TCCGAGGGCACCACCATCCTGCTGAACTGCACCGGACAGGTGAAGGGCCG

GAAACCTGCTGCTCTGGGAGAGGCCCAACCCACCAAGAGCCTGGAGGAGA

ACAAGTCCCTGAAGGAGCAGAAGAAGCTGAACGACCTGTGCTTCCTGAAG

AGGCTGCTGCAGGAGATCAAGACCTGCTGGAACAAGATCCTGATGGGCAC

CAAGGAGCATAGCGGCACAACCAACACAGTCGCTGCCTATAACCTCACTT

GGAAGAGCACCAACTTCAAAACCATCCTCGAATGGGAACCCAAACCCGTT

AACCAAGTTTACACCGTGCAGATCAGCACCAAGTCCGGCGACTGGAAGTC

CAAATGTTTCTATACCACCGACACCGAGTGCGATCTCACCGATGAGATCG

TGAAAGATGTGAAACAGACCTACCTCGCCCGGGTGTTTAGCTACCCCGCC

GGCAATGTGGAGAGCACTGGTTCCGCTGGCGAGCCTTTATACGAGAACAG

CCCCGAATTTACCCCTTACCTCGAGACCAATTTAGGACAGCCCACCATCC

AAAGCTTTGAGCAAGTTGGCACAAAGGTGAATGTGACAGTGGAGGACGAG

CGGACTTTAGTGCGGCGGAACAACACCTTTCTCAGCCTCCGGGATGTGTT

CGGCAAAGATTTAATCTACACACTGTATTACTGGAAGTCCTCTTCCTCCG

GCAAGAAGACAGCTAAAACCAACACAAACGAGTTTTTAATCGACGTGGAT

AAAGGCGAAAACTACTGTTTCAGCGTGCAAGCTGTGATCCCCTCCCGGAC

CGTGAATAGGAAAGCACCGATAGCCCCGTTGAGTGCATGGGCCAAGAA

AGGGCGAGTTCCGGGAGAACTGGGTGAACGTCATCAGCGATTTAAAGAAG

ATCGAAGATTAATTCAGTCCATGCATATCGACGCCACTTTATACAGA

ATCCGACGTGCACCCCTCTTGTAAGGTGACCGCCATGAAATGTTTTTAC

TGGAGCTGCAAGTTATCTCTTTAGAGAGCGGAGACGCTAGCATCCACGAC

ACCGTGGAGAATTTAATCATTTTAGCCAATAACTCTTTATCCAGCAACGG

-continued
CAACGTGACAGAGTCCGGCTGCAAGGAGTGCGAAGAGCTGGAGGAGAAGA

ACATCAAGGAGTTTCTGCAATCCTTTGTGCACATTGTCCAGATGTTCATC

AATACCTCC.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 211)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDSITCPPPMSVEHADIWVK

SYSLYSRERYICNSGFKRKAGTSSLTECVLNKATNVAHWTTPSLKCIR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 212)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCCAAGGAGTTCCTGGAGAGGTTCAAGTCCCTGCTGCAGAA

GATGATCCATCAGCACCTGTCCTCCAGGACCCACGGCTCCGAGGACTCCA

TTACATGCCCCCCTCCCATGAGCGTGGAGCACGCCGACATCTGGGTGAAG

AGCTATAGCCTCTACAGCCGGGAGAGGTATATCTGTAACAGCGGCTTCAA

GAGGAAGGCCGGCACCAGCAGCCTCACCGAGTGCGTGCTGAATAAGGCTA

CCAACGTGGCTCACTGGACAACACCCTCTTTAAAGTGCATCCGG.

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 213)
MKWVTFISLLFLFSSAYSQGQDRHMIRMRQLIDIVDQLKNYVNDLVPEFL

PAPEDVETNCEWSAFSCFQKAQLKSANTGNNERIINVSIKKLKRKPPSTN

AGRRQKHRLTCPSCDSYEKKPPKEFLERFKSLLQKMIHQHLSSRTHGSED

-continued

SITCPPPMSVEHADIWVKSYSLYSRERYICNSGFKRKAGTSSLTECVLNK

ATNVAHWTTPSLKCIR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 214)
ATGAAGTGGGTGACCTTCATCAGCCTGCTGTTCCTGTTCTCCAGCGCCTA

CTCCCAGGGCCAGGACAGGCACATGATCCGGATGAGGCAGCTCATCGACA

TCGTCGACCAGCTGAAGAACTACGTGAACGACCTGGTGCCCGAGTTTCTG

CCTGCCCCCGAGGACGTGGAGACCAACTGCGAGTGGTCCGCCTTCTCCTG

CTTTCAGAAGGCCCAGCTGAAGTCCGCCAACACCGGCAACAACGAGCGGA

TCATCAACGTGAGCATCAAGAAGCTGAAGCGGAAGCCTCCCTCCACAAAC

GCCGGCAGGAGGCAGAAGCACAGGCTGACCTGCCCCAGCTGTGACTCCTA

CGAGAAGAAGCCCCCCAAGGAGTTCCTGGAGAGGTTCAAGTCCCTGCTGC

AGAAGATGATCCATCAGCACCTGTCCTCCAGGACCCACGGCTCCGAGGAC

TCCATTACATGCCCCCCTCCCATGAGCGTGGAGCACGCCGACATCTGGGT

GAAGAGCTATAGCCTCTACAGCCGGGAGAGGTATATCTGTAACAGCGGCT

TCAAGAGGAAGGCCGGCACCAGCAGCCTCACCGAGTGCGTGCTGAATAAG

GCTACCAACGTGGCTCACTGGACAACACCCTCTTTAAAGTGCATCCGG.

Exemplary Multi-Chain Chimeric Polypeptides—Type E

In some embodiments of any of the multi-chain chimeric polypeptides described herein, the first target-binding domain and the second targeting-binding domain each independently bind specifically to a receptor for IL-18 (e.g., a soluble human IL-18), a receptor for IL-12 (e.g., a soluble human IL-12), or CD16 (e.g., an anti-CD16 scFv). In some embodiments of these multi-chain chimeric polypeptides described herein, the first chimeric polypeptide further includes the additional target-binding domain. In some embodiments of these multi-chain chimeric polypeptides described herein, the second chimeric polypeptide further includes the additional target-binding domain. In some embodiments of these multi-chain chimeric polypeptides described herein, the additional target-binding domain binds specifically to CD16 or a receptor for IL-12.

In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments, the second chimeric polypeptide further comprises one or more additional target-binding domains at the N-terminal end or the C-terminal end of the second chimeric polypeptide.

In some embodiments of these multi-chain chimeric polypeptides, the additional target-binding domain and the second domain of the pair of affinity domains directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the additional target-binding domain in the second chimeric polypeptide.

In some embodiments of these multi-chain chimeric polypeptides, the additional target-binding domain and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second target-binding domain and the additional target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, one or more of the first target-binding domain, the second target-binding domain and the additional antigen-binding domain is an agonistic antigen-binding domain. In some embodiments of these multi-chain chimeric polypeptides, the first target-binding domain, the second target-binding domain, and the additional antigen-binding domain are each agonistic antigen-binding domains. In some embodiments of these multi-chain chimeric polypeptides, the antigen-binding domain includes a scFv or single-domain antibody.

In some embodiments of these multi-chain chimeric polypeptides, one or both of the first target-binding domain and the second target-binding domain is a soluble IL-15 or a soluble IL-18. In some embodiments of these multi-chain chimeric polypeptides, the first target-binding domain and the second target-binding domain are each independently a soluble IL-15 or a soluble IL-18. In some embodiments of these multi-chain chimeric polypeptides, the first target-binding domain and the second target-binding domain both bind specifically to a receptor of IL-18 or a receptor of IL-12. In some embodiments of these multi-chain chimeric polypeptides, the first target-binding domain and the second target-binding domain bind specifically to the same epitope. In some embodiments of these multi-chain chimeric polypeptides, the first target-binding domain and the second target-binding domain include the same amino acid sequence.

In some embodiments of these multi-chain chimeric polypeptides, the first target-binding domain binds specifically to a receptor for IL-12, and the second target-binding domain binds specifically to a receptor for IL-18. In some embodiments of these multi-chain chimeric polypeptides, the first target-binding domain binds specifically to a receptor for IL-18, and the second target-binding domain bind specifically to a receptor for IL-12. In some embodiments of these multi-chain chimeric polypeptides, the first target-binding domain binds specifically to CD16, and the second target-binding domain binds specifically to a receptor for IL-18. In some embodiments of these multi-chain chimeric polypeptides, the first target-binding domain binds specifically to a receptor for IL-18, and the second target-binding domain bind specifically to CD16.

In some embodiments of these multi-chain chimeric polypeptides, two or more of the first target-binding domain, the second target-binding domain, and the one or more additional target-binding domains bind specifically to the same antigen. In some embodiments, two or more of the first target-binding domain, the second target-binding domain, and the one or more additional target-binding domains bind specifically to the same epitope. In some embodiments, two or more of the first target-binding domain, the second target-binding domain, and the one or more additional target-binding domains comprise the same amino acid sequence.

In some embodiments of these multi-chain chimeric polypeptides, the first target-binding domain includes a soluble IL-18 (e.g., a soluble human IL-18).

In some embodiments of these multi-chain chimeric polypeptides, the soluble human IL-18 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 109)
YFGKLESKLSVIRNLNDQVLFIDQGNRPLFEDMTDSDCRDNAPRTIFIIS

MYKDSQPRGMAVTISVKCEKISTLSCENKIISFKEMNPPDNIKDTKSDII

FFQRSVPGHDNKMQFESSSYEGYFLACEKERDLFKLILKKEDELGDRSIM

FTVQNED.

In some embodiments of these multi-chain chimeric polypeptides, the soluble human IL-18 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 171)
TACTTCGGCAAACTGGAATCCAAGCTGAGCGTGATCCGGAATTTAAACG

ACCAAGTTCTGTTTATCGATCAAGGTAACCGGCCTCTGTTCGAGGACAT

GACCGACTCCGATTGCCGGGACAATGCCCCCCGGACCATCTTCATTATC

TCCATGTACAAGGACAGCCAGCCCCGGGGCATGGCTGTGACAATTAGCG

TGAAGTGTGAGAAAATCAGCACTTTATCTTGTGAGAACAAGATCATCTC

CTTTAAGGAAATGAACCCCCCCGATAACATCAAGGACACCAAGTCCGAT

ATCATCTTCTTCCAGCGGTCCGTGCCCGGTCACGATAACAAGATGCAGT

TCGAATCCTCCTCCTACGAGGGCTACTTTTTAGCTTGTGAAAAGGAGAG

GGATTTATTCAAGCTGATCCTCAAGAAGGAGGACGAGCTGGGCGATCGT

TCCATCATGTTCACCGTCCAAAACGAGGAT.

In some embodiments of these multi-chain chimeric polypeptides, the second target-binding domain includes a soluble IL-12 (e.g., a soluble human IL-12). In some embodiments of these multi-chain chimeric polypeptides, the soluble human IL-15 includes a sequence of soluble human IL-12β (p40) and a sequence of soluble human IL-12α (p35). In some embodiments of these multi-chain chimeric polypeptides, the soluble IL-15 (e.g., soluble human IL-15) further includes a linker sequence (e.g., any of the exemplary linker sequences described herein) between the sequence of soluble IL-12β (p40) and the sequence of soluble human IL-12α (p35). In some examples of these multi-chain chimeric polypeptides, the linker sequence comprises GGGGSGGGGSGGGGS (SEQ ID NO: 102).

In some embodiments of these multi-chain chimeric polypeptides, the sequence of soluble human IL-12β (p40) comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 81)
IWELKKDVYVVELDWYPDAPGEMVVLTCDTPEEDGITWTLDQSSEVLGS

GKTLTIQVKEFGDAGQYTCHKGGEVLSHSLLLLHKKEDGIWSTDILKDQ

KEPKNKTFLRCEAKNYSGRFTCWWLTTISTDLTFSVKSSRGSSDPQGVT

CGAATLSAERVRGDNKEYEYSVECQEDSACPAAEESLPIEVMVDAVHKL

KYENYTSSFFIRDIIKPDPPKNLQLKPLKNSRQVEVSWEYPDTWSTPHS

YFSLTFCVQVQGKSKREKKDRVFTDKTSATVICRKNASISVRAQDRYYS

SSWSEWASVPCS.

In some embodiments of these multi-chain chimeric polypeptides, the soluble human IL-12β (p40) is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 172)
ATTTGGGAACTGAAGAAGGACGTCTACGTGGTCGAACTGGACTGGTATC

CCGATGCTCCCGGCGAAATGGTGGTGCTCACTTGTGACACCCCCGAAGA

AGACGGCATCACTTGGACCCTCGATCAGAGCAGCGAGGTGCTGGGCTCC

GGAAAGACCCTCACAATCCAAGTTAAGGAGTTCGGAGACGCTGGCCAAT

ACACATGCCACAAGGGAGGCGAGGTGCTCAGCCATTCCTTATTATTATT

ACACAAGAAGGAAGACGGAATCTGGTCCACCGACATTTTAAAAGATCAG

```
AAGGAGCCCAAGAATAAGACCTTTTTAAGGTGTGAGGCCAAAAACTACA

GCGGTCGTTTCACTTGTTGGTGGCTGACCACCATTTCCACCGATTTAAC

CTTCTCCGTGAAAAGCAGCCGGGGAAGCTCCGACCCTCAAGGTGTGACA

TGTGGAGCCGCTACCCTCAGCGCTGAGAGGGTTCGTGGCGATAACAAGG

AATACGAGTACAGCGTGGAGTGCCAAGAAGATAGCGCTTGTCCCGCTGC

CGAAGAATCTTTACCCATTGAGGTGATGGTGGACGCCGTGCACAAACTC

AAGTACGAGAACTACACCTCCTCCTTCTTTATCCGGGACATCATTAAGC

CCGATCCTCCTAAGAATTTACAGCTGAAGCCTCTCAAAAATAGCCGGCA

AGTTGAGGTCTCTTGGGAATATCCCGACACTTGGAGCACACCCCACAGC

TACTTCTCTTTAACCTTTTGTGTGCAAGTTCAAGGTAAAAGCAAGCGGG

AGAAGAAAGACCGGGTGTTTACCGACAAAACCAGCGCCACCGTCATCTG

TCGGAAGAACGCCTCCATCAGCGTGAGGGCTCAAGATCGTTATTACTCC

AGCAGCTGGTCCGAGTGGGCCAGCGTGCCTTGTTCC.
```

In some embodiments of these multi-chain chimeric polypeptides, the soluble human IL-12α (p35) includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                    (SEQ ID NO: 80)
RNLPVATPDPGMFPCLHHSQNLLRAVSNMLQKARQTLEFYPCTSEEIDH

EDITKDKTSTVEACLPLELTKNESCLNSRETSFITNGSCLASRKTSFMM

ALCLSSIYEDLKMYQVEFKTMNAKLLMDPKRQIFLDQNMLAVIDELMQA

LNFNSETVPQKSSLEEPDFYKTKIKLCILLHAFRIRAVTIDRVMSYLNA

S.
```

In some embodiments of these multi-chain chimeric polypeptides, the soluble human IL-12α (p35) is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                   (SEQ ID NO: 173)
CGTAACCTCCCCGTGGCTACCCCCGATCCCGGAATGTTCCCTTGTTTAC

ACCACAGCCAGAATTTACTGAGGGCCGTGAGCAACATGCTGCAGAAAGC

TAGGCAGACTTTAGAATTTTACCCTTGCACCAGCGAGGAGATCGACCAT

GAAGATATCACCAAGGACAAGACATCCACCGTGGAGGCTTGTTTACCTC

TGGAGCTGACAAAGAACGAGTCTTGTCTCAACTCTCGTGAAACCAGCTT

CATCACAAATGGCTCTTGTTTAGCTTCCCGGAAGACCTCCTTTATGATG

GCTTTATGCCTCAGCTCCATCTACGAGGATTTAAAGATGTACCAAGTGG

AGTTCAAGACCATGAACGCCAAGCTGCTCATGGACCCTAAACGGCAGAT

CTTTTTAGACCAGAACATGCTGGCTGTGATTGATGAGCTGATGCAAGCT

TTAAACTTCAACTCCGAGACCGTCCCTCAGAAGTCCTCCCTCGAGGAGC

CCGATTTTTACAAGACAAAGATCAAACTGTGCATTTTACTCCACGCCTT

TAGGATCCGGGCCGTGACCATTGACCGGGTCATGAGCTATTTAAACGCC

AGC.
```

In some embodiments of these multi-chain chimeric polypeptides, the additional target-binding domain includes an scFv that specifically binds to CD16 (e.g., an anti-CD16 scFv).

In some embodiments of these multi-chain chimeric polypeptides, the scFv that binds specifically to CD16 includes a light chain variable domain that includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                   (SEQ ID NO: 215)
SELTQDPAVSVALGQTVRITCQGDSLRSYYASWYQQKPGQAPVLVIYGK

NNRPSGIPDRFSGSSSGNTASLTITGAQAEDEADYYCNSRDSSGNHVVF

GGGTKLTVGH.
```

In some embodiments of these multi-chain chimeric polypeptides, the scFv that binds specifically to CD16 is encoded by a light chain variable domain sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                   (SEQ ID NO: 216)
TCCGAGCTGACCCAGGACCCTGCTGTGTCCGTGGCTCTGGGCCAGACCG

TGAGGATCACCTGCCAGGGCGACTCCCTGAGGTCCTACTACGCCTCCTG

GTACCAGCAGAAGCCCGGCCAGGCTCCTGTGCTGGTGATCTACGGCAAG

AACAACAGGCCCTCCGGCATCCCTGACAGGTTCTCCGGATCCTCCTCCG

GCAACACCGCCTCCCTGACCATCACAGGCGCTCAGGCCGAGGACGAGGC

TGACTACTACTGCAACTCCAGGGACTCCTCCGGCAACCATGTGGTGTTC

GGCGGCGGCACCAAGCTGACCGTGGGCCAT.
```

In some embodiments of these multi-chain chimeric polypeptides, the scFv that binds specifically to CD16 includes a heavy chain variable domain that includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                   (SEQ ID NO: 217)
EVQLVESGGGVVRPGGSLRLSCAASGFTFDDYGMSWVRQAPGKGLEWVS

GINWNGGSTGYADSVKGRFTISRDNAKNSLYLQMNSLRAEDTAVYYCAR

GRSLLFDYWGQGTLVTVSR.
```

In some embodiments of these multi-chain chimeric polypeptides, the scFv that binds specifically to CD16 is encoded by a heavy chain variable domain sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 218)
GAGGTGCAGCTGGTGGAGTCCGGAGGAGGAGTGGTGAGGCCTGGAGGCT

CCCTGAGGCTGAGCTGTGCTGCCTCCGGCTTCACCTTCGACGACTACGG

CATGTCCTGGGTGAGGCAGGCTCCTGGAAAGGGCCTGGAGTGGGTGTCC

GGCATCAACTGGAACGGCGGATCCACCGGCTACGCCGATTCCGTGAAGG

GCAGGTTCACCATCAGCAGGGACAACGCCAAGAACTCCCTGTACCTGCA

GATGAACTCCCTGAGGGCCGAGGACACCGCCGTGTACTACTGCGCCAGG

GGCAGGTCCCTGCTGTTCGACTACGGGGACAGGGCACCCTGGTGACCG

TGTCCAGG.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 174)
YFGKLESKLSVIRNLNDQVLFIDQGNRPLFEDMTDSDCRDNAPRTIFII

SMYKDSQPRGMAVTISVKCEKISTLSCENKIISFKEMNPPDNIKDTKSD

IIFFQRSVPGHDNKMQFESSSYEGYFLACEKERDLFKLILKKEDELGDR

SIMFTVQNEDSGTTNTVAAYNLTWKSTNFKTILEWEPKPVNQVYTVQIS

TKSGDWKSKCFYTTDTECDLTDEIVKDVKQTYLARVFSYPAGNVESTGS

AGEPLYENSPEFTPYLETNLGQPTIQSFEQVGTKVNVTVEDERTLVRRN

NTFLSLRDVFGKDLIYTLYYWKSSSSGKKTAKTNTNEFLIDVDKGENYC

FSVQAVIPSRTVNRKSTDSPVECMGQEKGEFRENWVNVISDLKKIEDLI

QSMHIDATLYTESDVHPSCKVTAMKCFLLELQVISLESGDASIHDTVEN

LIILANNSLSSNGNVTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 175)
TACTTCGGCAAACTGGAATCCAAGCTGAGCGTGATCCGGAATTTAAACG

ACCAAGTTCTGTTTATCGATCAAGGTAACCGGCCTCTGTTCGAGGACAT

GACCGACTCCGATTGCCGGGACAATGCCCCCCGGACCATCTTCATTATC

TCCATGTACAAGGACAGCCAGCCCCGGGGCATGGCTGTGACAATTAGCG

TGAAGTGTGAGAAAATCAGCACTTTATCTTGTGAGAACAAGATCATCTC

CTTTAAGGAAATGAACCCCCCCGATAACATCAAGGACACCAAGTCCGAT

ATCATCTTCTTCCAGCGGTCCGTGCCCGGTCACGATAACAAGATGCAGT

TCGAATCCTCCTCCTACGAGGGCTACTTTTTAGCTTGTGAAAAGGAGAG

GGATTTATTCAAGCTGATCCTCAAGAAGGAGGACGAGCTGGGCGATCGT

TCCATCATGTTCACCGTCCAAAACGAGGATAGCGGCACAACCAACACAG

TCGCTGCCTATAACCTCACTTGGAAGAGCACCAACTTCAAAACCATCCT

CGAATGGGAACCCAAACCCGTTAACCAAGTTTACACCGTGCAGATCAGC

ACCAAGTCCGGCGACTGGAAGTCCAAATGTTTCTATACCACCGACACCG

AGTGCGATCTCACCGATGAGATCGTGAAAGATGTGAAACAGACCTACCT

CGCCCGGGTGTTTAGCTACCCCGCCGGCAATGTGGAGAGCACTGGTTCC

GCTGGCGAGCCTTTATACGAGAACAGCCCCGAATTTACCCCTTACCTCG

AGACCAATTTAGGACAGCCCACCATCCAAAGCTTTGAGCAAGTTGGCAC

AAAGGTGAATGTGACAGTGGAGGACGAGCGGACTTTAGTGCGGCGGAAC

AACACCTTTCTCAGCCTCCGGGATGTGTTCGGCAAAGATTTAATCTACA

CACTGTATTACTGGAAGTCCTCTTCCTCCGGCAAGAAGACAGCTAAAAC

CAACACAAACGAGTTTTTAATCGACGTGGATAAAGGCGAAAACTACTGT

TTCAGCGTGCAAGCTGTGATCCCCTCCCGGACCGTGAATAGGAAAAGCA

CCGATAGCCCCGTTGAGTGCATGGGCCAAGAAAAGGGCGAGTTCCGGGA

GAACTGGGTGAACGTCATCAGCGATTTAAAGAAGATCGAAGATTTAATT

CAGTCCATGCATATCGACGCCACTTTATACACAGAATCCGACGTGCACC

CCTCTTGTAAGGTGACCGCCATGAAATGTTTTTTACTGGAGCTGCAAGT

TATCTCTTTAGAGAGCGGAGACGCTAGCATCCACGACACCGTGGAGAAT

TTAATCATTTTAGCCAATAACTCTTTATCCAGCAACGGCAACGTGACAG

AGTCCGGCTGCAAGGAGTGCGAAGAGCTGGAGGAGAAGAACATCAAGGA

GTTTCTGCAATCCTTTGTGCACATTGTCCAGATGTTCATCAATACCTCC.

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 176)
MKWVTFISLLFLFSSAYSYFGKLESKLSVIRNLNDQVLFIDQGNRPLFE

DMTDSDCRDNAPRTIFIISMYKDSQPRGMAVTISVKCEKISTLSCENKI

ISFKEMNPPDNIKDTKSDIIFFQRSVPGHDNKMQFESSSYEGYFLACEK

ERDLFKLILKKEDELGDRSIMFTVQNEDSGTTNTVAAYNLTWKSTNFKT

ILEWEPKPVNQVYTVQISTKSGDWKSKCFYTTDTECDLTDEIVKDVKQT

YLARVFSYPAGNVESTGSAGEPLYENSPEFTPYLETNLGQPTIQSFEQV

GTKVNVTVEDERTLVRRNNTFLSLRDVFGKDLIYTLYYWKSSSSGKKTA

KTNTNEFLIDVDKGENYCFSVQAVIPSRTVNRKSTDSPVECMGQEKGEF

RENWVNVISDLKKIEDLIQSMHIDATLYTESDVHPSCKVTAMKCFLLEL

QVISLESGDASIHDTVENLIILANNSLSSNGNVTESGCKECEELEEKNI

KEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 177)
ATGAAGTGGGTCACATTTATCTCTTTACTGTTCCTCTTCTCCAGCGCCT
ACAGCTACTTCGGCAAACTGGAATCCAAGCTGAGCGTGATCCGGAATTT
AAACGACCAAGTTCTGTTTATCGATCAAGGTAACCGGCCTCTGTTCGAG
GACATGACCGACTCCGATTGCCGGGACAATGCCCCCCGGACCATCTTCA
TTATCTCCATGTACAAGGACAGCCAGCCCCGGGGCATGGCTGTGACAAT
TAGCGTGAAGTGTGAGAAAATCAGCACTTTATCTTGTGAGAACAAGATC
ATCTCCTTTAAGGAAATGAACCCCCCCGATAACATCAAGGACACCAAGT
CCGATATCATCTTCTTCCAGCGGTCCGTGCCCGGTCACGATAACAAGAT
GCAGTTCGAATCCTCCTCCTACGAGGGCTACTTTTTAGCTTGTGAAAAG
GAGAGGGATTTATTCAAGCTGATCCTCAAGAAGGAGGACGAGCTGGGCG
ATCGTTCCATCATGTTCACCGTCCAAAACGAGGATAGCGGCACAACCAA
CACAGTCGCTGCCTATAACCTCACTTGGAAGAGCACCAACTTCAAAACC
ATCCTCGAATGGGAACCCAAACCCGTTAACCAAGTTTACACCGTGCAGA
TCAGCACCAAGTCCGGCGACTGGAAGTCCAAATGTTTCTATACCACCGA
CACCGAGTGCGATCTCACCGATGAGATCGTGAAAGATGTGAAACAGACC
TACCTCGCCCGGTGTTTAGCTACCCCGCCGGCAATGTGGAGAGCACTG
GTTCCGCTGGCGAGCCTTTATACGAGAACAGCCCCGAATTTACCCCTTA
CCTCGAGACCAATTTAGGACAGCCCACCATCCAAAGCTTTGAGCAAGTT
GGCACAAAGGTGAATGTGACAGTGGAGGACGAGCGGACTTTAGTGCGGC
GGAACAACACCTTTCTCAGCCTCCGGGATGTGTTCGGCAAAGATTTAAT
CTACACACTGTATTACTGGAAGTCCTCTTCCTCCGGCAAGAAGACAGCT
AAAACCAACACAAACGAGTTTTTAATCGACGTGGATAAAGGCGAAAACT
ACTGTTTCAGCGTGCAAGCTGTGATCCCCTCCCGGACCGTGAATAGGAA
AAGCACCGATAGCCCCGTTGAGTGCATGGGCCAAGAAAAGGGCGAGTTC
CGGGAGAACTGGGTGAACGTCATCAGCGATTTAAAGAAGATCGAAGATT
TAATTCAGTCCATGCATATCGACGCCACTTTATACACAGAATCCGACGT
GCACCCCTCTTGTAAGGTGACCGCCATGAAATGTTTTTTACTGGAGCTG
CAAGTTATCTCTTTAGAGAGCGGAGACGCTAGCATCCACGACACCGTGG
AGAATTTAATCATTTTAGCCAATAACTCTTTATCCAGCAACGGCAACGT
GACAGAGTCCGGCTGCAAGGAGTGCGAAGAGCTGGAGGAGAAGAACATC
AAGGAGTTTCTGCAATCCTTTGTGCACATTGTCCAGATGTTCATCAATA
CCTCC.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 223)
IWELKKDVYVVELDWYPDAPGEMVVLTCDTPEEDGITWTLDQSSEVLGS
GKTLTIQVKEFGDAGQYTCHKGGEVLSHSLLLLHKKEDGIWSTDILKDQ
KEPKNKTFLRCEAKNYSGRFTCWWLTTISTDLTFSVKSSRGSSDPQGVT
CGAATLSAERVRGDNKEYEYSVECQEDSACPAAEESLPIEVMVDAVHKL
KYENYTSSFFIRDIIKPDPPKNLQLKPLKNSRQVEVSWEYPDTWSTPHS
YFSLTFCVQVQGKSKREKKDRVFTDKTSATVICRKNASISVRAQDRYYS
SSWSEWASVPCSGGGGSGGGGSGGGGSRNLPVATPDPGMFPCLHHSQNL
LRAVSNMLQKARQTLEFYPCTSEEIDHEDITKDKTSTVEACLPLELTKN
ESCLNSRETSFITNGSCLASRKTSFMMALCLSSIYEDLKMYQVEFKTMN
AKLLMDPKRQIFLDQNMLAVIDELMQALNFNSETVPQKSSLEEPDFYKT
KIKLCILLHAFRIRAVTIDRVMSYLNASITCPPPMSVEHADIWVKSYSL
YSRERYICNSGFKRKAGTSSLTECVLNKATNVAHWTTPSLKCIRSELTQ
DPAVSVALGQTVRITCQGDSLRSYYASWYQQKPGQAPVLVIYGKNNRPS
GIPDRFSGSSSGNTASLTITGAQAEDEADYYCNSRDSSGNHVVFGGGTK
LTVGHGGGGSGGGGSGGGGSEVQLVESGGGVVRPGGSLRLSCAASGFTF
DDYGMSWVRQAPGKGLEWVSGINWNGGSTGYADSVKGRFTISRDNAKNS
LYLQMNSLRAEDTAVYYCARGRSLLFDYWGQGTLVTVSR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 224)
ATTTGGGAACTGAAGAAGGACGTCTACGTGGTCGAACTGGACTGGTATC
CCGATGCTCCCGGCGAAATGGTGGTGCTCACTTGTGACACCCCCGAAGA
AGACGGCATCACTTGGACCCTCGATCAGAGCAGCGAGGTGCTGGGCTCC
GGAAAGACCCTCACAATCCAAGTTAAGGAGTTCGGAGACGCTGGCCAAT
ACACATGCCACAAGGGAGGCGAGGTGCTCAGCCATTCCTTATTATTATT
ACACAAGAAGGAAGACGGAATCTGGTCCACCGACATTTTAAAAGATCAG
AAGGAGCCCAAGAATAAGACCTTTTTAAGGTGTGAGGCCAAAAACTACA
GCGGTCGTTTCACTTGTTGGTGGCTGACCACCATTTCCACCGATTTAAC
CTTCTCCGTGAAAAGCAGCCGGGGAAGCTCCGACCCTCAAGGTGTGACA
TGTGGAGCCGCTACCCTCAGCGCTGAGAGGGTTCGTGGCGATAACAAGG
AATACGAGTACAGCGTGGAGTGCCAAGAAGATAGCGCTTGTCCCGCTGC
CGAAGAATCTTTACCCATTGAGGTGATGGTGGACGCCGTGCACAAACTC
AAGTACGAGAACTACACCTCCTCCTTCTTTATCCGGGACATCATTAAGC
CCGATCCTCCTAAGAATTTACAGCTGAAGCCTCTCAAAAATAGCCGGCA
AGTTGAGGTCTCTTGGGAATATCCCGACACTTGGAGCACACCCCACAGC

```
TACTTCTCTTTAACCTTTTGTGTGCAAGTTCAAGGTAAAAGCAAGCGGG

AGAAGAAAGACCGGGTGTTTACCGACAAAACCAGCGCCACCGTCATCTG

TCGGAAGAACGCCTCCATCAGCGTGAGGGCTCAAGATCGTTATTACTCC

AGCAGCTGGTCCGAGTGGGCCAGCGTGCCTTGTTCCGGCGGTGGAGGAT

CCGGAGGAGGTGGCTCCGGCGGCGGAGGATCTCGTAACCTCCCCGTGGC

TACCCCCGATCCCGGAATGTTCCCTTGTTTACACCACAGCCAGAATTTA

CTGAGGGCCGTGAGCAACATGCTGCAGAAAGCTAGGCAGACTTTAGAAT

TTTACCCTTGCACCAGCGAGGAGATCGACCATGAAGATATCACCAAGGA

CAAGACATCCACCGTGGAGGCTTGTTTACCTCTGGAGCTGACAAAGAAC

GAGTCTTGTCTCAACTCTCGTGAAACCAGCTTCATCACAAATGGCTCTT

GTTTAGCTTCCCGGAAGACCTCCTTTATGATGGCTTTATGCCTCAGCTC

CATCTACGAGGATTTAAAGATGTACCAAGTGGAGTTCAAGACCATGAAC

GCCAAGCTGCTCATGGACCCTAAACGGCAGATCTTTTTAGACCAGAACA

TGCTGGCTGTGATTGATGAGCTGATGCAAGCTTTAAACTTCAACTCCGA

GACCGTCCCTCAGAAGTCCTCCCTCGAGGAGCCCGATTTTTACAAGACA

AAGATCAAACTGTGCATTTTACTCCACGCCTTTAGGATCCGGGCCGTGA

CCATTGACCGGGTCATGAGCTATTTAAACGCCAGCATTACATGCCCCCC

TCCCATGAGCGTGGAGCACGCCGACATCTGGGTGAAGAGCTATAGCCTC

TACAGCCGGGAGAGGTATATCTGTAACAGCGGCTTCAAGAGGAAGGCCG

GCACCAGCAGCCTCACCGAGTGCGTGCTGAATAAGGCTACCAACGTGGC

TCACTGGACAACACCCTCTTTAAAGTGCATCCGGTCCGAGCTGACCCAG

GACCCTGCTGTGTCCGTGGCTCTGGGCCAGACCGTGAGGATCACCTGCC

AGGGCGACTCCCTGAGGTCCTACTACGCCTCCTGGTACCAGCAGAAGCC

CGGCCAGGCTCCTGTGCTGGTGATCTACGGCAAGAACAACAGGCCCTCC

GGCATCCCTGACAGGTTCTCCGGATCCTCCTCCGGCAACACCGCCTCCC

TGACCATCACAGGCGCTCAGGCCGAGGACGAGGCTGACTACTACTGCAA

CTCCAGGGACTCCTCCGGCAACCATGTGGTGTTCGGCGGCGGCACCAAG

CTGACCGTGGGCCATGGCGGCGGCGGCTCCGGAGGCGGCGGCAGCGGCG

GAGGAGGATCCGAGGTGCAGCTGGTGGAGTCCGGAGGAGGAGTGGTGAG

GCCTGGAGGCTCCCTGAGGCTGAGCTGTGCTGCCTCCGGCTTCACCTTC

GACGACTACGGCATGTCCTGGGTGAGGCAGGCTCCTGGAAAGGGCCTGG

AGTGGGTGTCCGGCATCAACTGGAACGGCGGATCCACCGGCTACGCCGA

TTCCGTGAAGGGCAGGTTCACCATCAGCAGGGACAACGCCAAGAACTCC

CTGTACCTGCAGATGAACTCCCTGAGGGCCGAGGACACCGCCGTGTACT

ACTGCGCCAGGGGCAGGTCCCTGCTGTTCGACTACTGGGGACAGGGCAC

CCTGGTGACCGTGTCCAGG.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 225)
MKWVTFISLLFLFSSAYSIWELKKDVYVVELDWYPDAPGEMVVLTCDTP

EEDGITWTLDQSSEVLGSGKTLTIQVKEFGDAGQYTCHKGGEVLSHSLL

LLHKKEDGIWSTDILKDQKEPKNKTFLRCEAKNYSGRFTCWWLTTISTD

LTFSVKSSRGSSDPQGVTCGAATLSAERVRGDNKEYEYSVECQEDSACP

AAEESLPIEVMVDAVHKLKYENYTSSFFIRDIIKPDPPKNLQLKPLKNS

RQVEVSWEYPDTWSTPHSYFSLTFCVQVQGKSKREKKDRVFTDKTSATV

ICRKNASISVRAQDRYYSSSWSEWASVPCSGGGGSGGGGSGGGGSRNLP

VATPDPGMFPCLHHSQNLLRAVSNMLQKARQTLEFYPCTSEEIDHEDIT

KDKTSTVEACLPLELTKNESCLNSRETSFITNGSCLASRKTSFMMALCL

SSIYEDLKMYQVEFKTMNAKLLMDPKRQIFLDQNMLAVIDELMQALNEN

SETVPQKSSLEEPDFYKTKIKLCILLHAFRIRAVTIDRVMSYLNASITC

PPPMSVEHADIWVKSYSLYSRERYICNSGFKRKAGTSSLTECVLNKATN

VAHWTTPSLKCIRSELTQDPAVSVALGQTVRITCQGDSLRSYYASWYQQ

KPGQAPVLVIYGKNNRPSGIPDRFSGSSSGNTASLTITGAQAEDEADYY

CNSRDSSGNHVVFGGGTKLTVGHGGGGSGGGGSGGGGSEVQLVESGGGV

VRPGGSLRLSCAASGFTFDDYGMSWVRQAPGKGLEWVSGINWNGGSTGY

ADSVKGRFTISRDNAKNSLYLQMNSLRAEDTAVYYCARGRSLLFDYWGQ

GTLVTVSR.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 226)
ATGAAATGGGTGACCTTTATTTCTTTACTGTTCCTCTTTAGCAGCGCCT

ACTCCATTTGGGAACTGAAGAAGGACGTCTACGTGGTCGAACTGGACTG

GTATCCCGATGCTCCCGGCGAAATGGTGGTGCTCACTTGTGACACCCCC

GAAGAAGACGGCATCACTTGGACCCTCGATCAGAGCAGCGAGGTGCTGG

GCTCCGGAAAGACCCTCACAATCCAAGTTAAGGAGTTCGGAGACGCTGG

CCAATACACATGCCACAAGGGAGGCGAGGTGCTCAGCCATTCCTTATTA

TTATTACACAAGAAGGAAGACGGAATCTGGTCCACCGACATTTTAAAAG

ATCAGAAGGAGCCCAAGAATAAGACCTTTTTAAGGTGTGAGGCCAAAAA

CTACAGCGGTCGTTTCACTTGTTGGTGGCTGACCACCATTTCCACCGAT

TTAACCTTCTCCGTGAAAAGCAGCCGGGGAAGCTCCGACCCTCAAGGTG

TGACATGTGGAGCCGCTACCCTCAGCGCTGAGAGGGTTCGTGGCGATAA

CAAGGAATACGAGTACAGCGTGGAGTGCCAAGAAGATAGCGCTTGTCCC

GCTGCCGAAGAATCTTTACCCATTGAGGTGATGGTGGACGCCGTGCACA

AACTCAAGTACGAGAACTACACCTCCTCCTTCTTTATCCGGGACATCAT

TAAGCCCGATCCTCCTAAGAATTTACAGCTGAAGCCTCTCAAAAATAGC

CGGCAAGTTGAGGTCTCTTGGGAATATCCCGACACTTGGAGCACACCCC
```

```
                    -continued
ACAGCTACTTCTCTTTAACCTTTTGTGTGCAAGTTCAAGGTAAAAGCAA

GCGGGAGAAGAAAGACCGGGTGTTTACCGACAAAACCAGCGCCACCGTC

ATCTGTCGGAAGAACGCCTCCATCAGCGTGAGGGCTCAAGATCGTTATT

ACTCCAGCAGCTGGTCCGAGTGGGCCAGCGTGCCTTGTTCCGGCGGTGG

AGGATCCGGAGGAGGTGGCTCCGGCGGCGGAGGATCTCGTAACCTCCCC

GTGGCTACCCCCGATCCCGGAATGTTCCCTTGTTTACACCACAGCCAGA

ATTTACTGAGGGCCGTGAGCAACATGCTGCAGAAAGCTAGGCAGACTTT

AGAATTTTACCCTTGCACCAGCGAGGAGATCGACCATGAAGATATCACC

AAGGACAAGACATCCACCGTGGAGGCTTGTTTACCTCTGGAGCTGACAA

AGAACGAGTCTTGTCTCAACTCTCGTGAAACCAGCTTCATCACAAATGG

CTCTTGTTTAGCTTCCCGGAAGACCTCCTTTATGATGGCTTTATGCCTC

AGCTCCATCTACGAGGATTTAAAGATGTACCAAGTGGAGTTCAAGACCA

TGAACGCCAAGCTGCTCATGGACCCTAAACGGCAGATCTTTTTAGACCA

GAACATGCTGGCTGTGATTGATGAGCTGATGCAAGCTTTAAACTTCAAC

TCCGAGACCGTCCCTCAGAAGTCCTCCCTCGAGGAGCCCGATTTTTACA

AGACAAAGATCAAACTGTGCATTTTACTCCACGCCTTTAGGATCCGGGC

CGTGACCATTGACCGGGTCATGAGCTATTTAAACGCCAGCATTACATGC

CCCCCTCCCATGAGCGTGGAGCACGCCGACATCTGGGTGAAGAGCTATA

GCCTCTACAGCCGGGAGAGGTATATCTGTAACAGCGGCTTCAAGAGGAA

GGCCGGCACCAGCAGCCTCACCGAGTGCGTGCTGAATAAGGCTACCAAC

GTGGCTCACTGGACAACACCCTCTTTAAAGTGCATCCGGTCCGAGCTGA

CCCAGGACCCTGCTGTGTCCGTGGCTCTGGGCCAGACCGTGAGGATCAC

CTGCCAGGGCGACTCCCTGAGGTCCTACTACGCCTCCTGGTACCAGCAG

AAGCCCGGCCAGGCTCCTGTGCTGGTGATCTACGGCAAGAACAACAGGC

CCTCCGGCATCCCTGACAGGTTCTCCGGATCCTCCTCCGGCAACACCGC

CTCCCTGACCATCACAGGCGCTCAGGCCGAGGACGAGGCTGACTACTAC

TGCAACTCCAGGGACTCCTCCGGCAACCATGTGGTGTTCGGCGGCGGCA

CCAAGCTGACCGTGGGCCATGGCGGCGGCGGCTCCGGAGGCGGCGGCAG

CGGCGGAGGAGGATCCGAGGTGCAGCTGGTGGAGTCCGGAGGAGGAGTG

GTGAGGCCTGGAGGCTCCCTGAGGCTGAGCTGTGCTGCCTCCGGCTTCA

CCTTCGACGACTACGGCATGTCCTGGGTGAGGCAGGCTCCTGGAAAGGG

CCTGGAGTGGGTGTCCGGCATCAACTGGAACGGCGGATCCACCGGCTAC

GCCGATTCCGTGAAGGGCAGGTTCACCATCAGCAGGGACAACGCCAAGA

ACTCCCTGTACCTGCAGATGAACTCCCTGAGGGCCGAGGACACCGCCGT

GTACTACTGCGCCAGGGGCAGGTCCCTGCTGTTCGACTACTGGGGACAG

GGCACCCTGGTGACCGTGTCCAGG.
```

Exemplary Multi-Chain Chimeric Polypeptides—Type F

In some embodiments of any of the multi-chain chimeric polypeptides described herein, the first target-binding domain and the second targeting-binding domain each independently bind specifically to a receptor for IL-7 (e.g., a soluble human IL-7), CD16 (e.g., an anti-CD16 scFv), or a receptor for IL-21 (e.g., a soluble human IL-21). In some embodiments of these multi-chain chimeric polypeptides described herein, the first chimeric polypeptide further includes the additional target-binding domain. In some embodiments of these multi-chain chimeric polypeptides described herein, the second chimeric polypeptide further includes the additional target-binding domain. In some embodiments of these multi-chain chimeric polypeptides described herein, the additional target-binding domain binds specifically to CD16 or a receptor for IL-21.

In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments, the second chimeric polypeptide further comprises one or more additional target-binding domains at the N-terminal end or the C-terminal end of the second chimeric polypeptide.

In some embodiments of these multi-chain chimeric polypeptides, the additional target-binding domain and the second domain of the pair of affinity domains directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the additional target-binding domain in the second chimeric polypeptide.

In some embodiments of these multi-chain chimeric polypeptides, the additional target-binding domain and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second target-binding domain and the additional target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, one or more of the first target-binding domain, the second target-binding domain and the additional antigen-binding domain is an agonistic antigen-binding domain. In some embodiments of these multi-chain chimeric polypeptides, the first target-binding domain, the second target-binding domain, and the additional antigen-binding domain are each agonistic antigen-binding domains. In some embodiments of these multi-chain chimeric polypeptides, the antigen-binding domain includes a scFv or single-domain antibody.

In some embodiments of any of the multi-chain chimeric polypeptides described herein, the first target-binding domain binds specifically to a receptor IL-7 and the second target-binding domain binds specifically to CD16 or a receptor for IL-21. In some embodiments of any of the multi-chain chimeric polypeptides described herein, the first target-binding domain includes a soluble IL-7 protein. In some embodiments of any of the multi-chain chimeric polypeptides described herein, the soluble IL-7 protein is a soluble human IL-7. In some embodiments of any of the multi-chain chimeric polypeptides described herein, the second antigen-binding domain includes a target-binding domain that binds specifically to CD16. In some embodiments of any of the multi-chain chimeric polypeptides described herein, the second target-binding domain includes an scFv that binds specifically to CD16. In some embodiments of any of the multi-chain chimeric polypeptides described herein, the second target-binding domain binds specifically to a receptor for IL-21. In some embodiments of any of the multi-chain chimeric polypeptides described herein, the second target-binding domain includes a soluble IL-21. In some embodiments of any of the multi-chain chimeric polypeptides described herein, the soluble IL-21 is a soluble human IL-21. In some embodiments of any of the multi-chain chimeric polypeptides described herein, the second chimeric polypeptide further includes an additional target-binding domain that binds specifically to a receptor for IL-21. In some embodiments of any of the multi-chain chimeric polypeptides described herein, the additional target-binding domain includes a soluble IL-21. In some embodiments of any of the multi-chain chimeric polypeptides described herein, the soluble IL-21 is a soluble human IL-21. In some embodiments of any of the multi-chain chimeric polypeptides described herein, the second chimeric polypeptide further includes an additional target-binding domain that binds specifically to CD16.

In some embodiments of these multi-chain chimeric polypeptides, two or more of the first target-binding domain, the second target-binding domain, and the one or more additional target-binding domains bind specifically to the same antigen. In some embodiments, two or more of the first target-binding domain, the second target-binding domain, and the one or more additional target-binding domains bind specifically to the same epitope. In some embodiments, two or more of the first target-binding domain, the second target-binding domain, and the one or more additional target-binding domains comprise the same amino acid sequence.

In some embodiments of these multi-chain chimeric polypeptides, the first target-binding domain includes a soluble IL-7 (e.g., a soluble human IL-7).

In some embodiments of these multi-chain chimeric polypeptides, the soluble human IL-7 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 79)
DCDIEGKDGKQYESVLMVSIDQLLDSMKEIGSNCLNNEFNFFKRHICDA

NKEGMFLFRAARKLRQFLKMNSTGDFDLHLLKVSEGTTILLNCTGQVKG

RKPAALGEAQPTKSLEENKSLKEQKKLNDLCFLKRLLQEIKTCWNKILM

GTKEH.

In some embodiments of these multi-chain chimeric polypeptides, the soluble human IL-7 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 198)
GATTGTGATATTGAAGGTAAAGATGGCAAACAATATGAGAGTGTTCTAA

TGGTCAGCATCGATCAATTATTGGACAGCATGAAAGAAATTGGTAGCAA

TTGCCTGAATAATGAATTTAACTTTTTTAAAAGACATATCTGTGATGCT

AATAAGGAAGGTATGTTTTTATTCCGTGCTGCTCGCAAGTTGAGGCAAT

TTCTTAAAATGAATAGCACTGGTGATTTTGATCTCCACTTATTAAAAGT

TTCAGAAGGCACAACAATACTGTTGAACTGCACTGGCCAGGTTAAAGGA

AGAAAACCAGCTGCCCTGGGTGAAGCCCAACCAACAAAGAGTTTGGAAG

AAAATAAATCTTTAAAGGAACAGAAAAAACTGAATGACTTGTGTTTCCT

AAAGAGACTATTACAAGAGATAAAAACTTGTTGGAATAAAATTTTGATG

GGCACTAAAGAACAC.

In some embodiments of these multi-chain chimeric polypeptides, the soluble human IL-7 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 227)
GATTGCGACATCGAGGGCAAGGACGGCAAGCAGTACGAGAGCGTGCTGA

TGGTGTCCATCGACCAGCTGCTGGACAGCATGAAGGAGATCGGCTCCAA

CTGCCTCAACAACGAGTTCAACTTCTTCAAGCGGCACATCTGCGACGCC

AACAAGGAGGGCATGTTCCTGTTCAGGGCCGCCAGGAAACTGCGGCAGT

TCCTGAAGATGAACTCCACCGGCGACTTCGACCTGCACCTGCTGAAGGT

GTCCGAGGGCACCACCATCCTGCTGAACTGCACCGGACAGGTGAAGGGC

CGGAAACCTGCTGCTCTGGGAGAGGCCCAACCCACCAAGAGCCTGGAGG

AGAACAAGTCCCTGAAGGAGCAGAAGAAGCTGAACGACCTGTGCTTCCT

GAAGAGGCTGCTGCAGGAGATCAAGACCTGCTGGAACAAGATCCTGATG

GGCACCAAGGAGCAT.

In some embodiments of these multi-chain chimeric polypeptides, the sequence of soluble human IL-21 comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 83)
QGQDRHMIRMRQLIDIVDQLKNYVNDLVPEFLPAPEDVETNCEWSAFSC

FQKAQLKSANTGNNERIINVSIKKLKRKPPSTNAGRRQKHRLTCPSCDS

YEKKPPKEFLERFKSLLQKMIHQHLSSRTHGSEDS.

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 197)
CAAGGTCAAGATCGCCACATGATTAGAATGCGTCAACTTATAGATATTG

TTGATCAGCTGAAAAATTATGTGAATGACTTGGTCCCTGAATTTCTGCC

AGCTCCAGAAGATGTAGAGACAAACTGTGAGTGGTCAGCTTTTTCCTGT

TTTCAGAAGGCCCAACTAAAGTCAGCAAATACAGGAAACAATGAAAGGA

TAATCAATGTATCAATTAAAAAGCTGAAGAGGAAACCACCTTCCACAAA

TGCAGGGAGAAGACAGAAACACAGACTAACATGCCCTTCATGTGATTCT

TATGAGAAAAAACCACCCAAAGAATTCCTAGAAAGATTCAAATCACTTC

TCCAAAAGATGATTCATCAGCATCTGTCCTCTAGAACACACGGAAGTGA

AGATTCC.

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 182)
CAGGGCCAGGACAGGCACATGATCCGGATGAGGCAGCTCATCGACATCG

TCGACCAGCTGAAGAACTACGTGAACGACCTGGTGCCCGAGTTTCTGCC

TGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGA

TCATCAACGTGAGCATCAAGAAGCTGAAGCGGAAGCCTCCCTCCACAAA

CGCCGGCAGGAGGCAGAAGCACAGGCTGACCTGCCCCAGCTGTGACTCC

TACGAGAAGAAGCCCCCCAAGGAGTTCCTGGAGAGGTTCAAGTCCCTGC

TGCAGAAGATGATCCATCAGCACCTGTCCTCCAGGACCCACGGCTCCGA

GGACTCC.

In some embodiments of these multi-chain chimeric polypeptides, the additional target-binding domain includes an scFv that specifically binds to CD16 (e.g., an anti-CD16 scFv).

In some embodiments of these multi-chain chimeric polypeptides, the scFv that binds specifically to CD16 includes a light chain variable domain that includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 215)
SELTQDPAVSVALGQTVRITCQGDSLRSYYASWYQQKPGQAPVLVIYGK

NNRPSGIPDRFSGSSSGNTASLTITGAQAEDEADYYCNSRDSSGNHVVF

GGGTKLTVGH.

In some embodiments of these multi-chain chimeric polypeptides, the scFv that binds specifically to CD16 is encoded by a light chain variable domain sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 216)
TCCGAGCTGACCCAGGACCCTGCTGTGTCCGTGGCTCTGGGCCAGACCG

TGAGGATCACCTGCCAGGGCGACTCCCTGAGGTCCTACTACGCCTCCTG

GTACCAGCAGAAGCCCGGCCAGGCTCCTGTGCTGGTGATCTACGGCAAG

AACAACAGGCCCTCCGGCATCCCTGACAGGTTCTCCGGATCCTCCTCCG

GCAACACCGCCTCCCTGACCATCACAGGCGCTCAGGCCGAGGACGAGGC

TGACTACTACTGCAACTCCAGGGACTCCTCCGGCAACCATGTGGTGTTC

GGCGGCGGCACCAAGCTGACCGTGGGCCAT.

In some embodiments of these multi-chain chimeric polypeptides, the scFv that binds specifically to CD16 includes a heavy chain variable domain that includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 217)
EVQLVESGGGVVRPGGSLRLSCAASGFTFDDYGMSWVRQAPGKGLEWVS

GINWNGGSTGYADSVKGRFTISRDNAKNSLYLQMNSLRAEDTAVYYCAR

GRSLLFDYWGQGTLVTVSR.

In some embodiments of these multi-chain chimeric polypeptides, the scFv that binds specifically to CD16 is encoded by a heavy chain variable domain sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 218)
GAGGTGCAGCTGGTGGAGTCCGGAGGAGGAGTGGTGAGGCCTGGAGGCT

CCCTGAGGCTGAGCTGTGCTGCCTCCGGCTTCACCTTCGACGACTACGG

CATGTCCTGGGTGAGGCAGGCTCCTGGAAAGGGCCTGGAGTGGGTGTCC

GGCATCAACTGGAACGGCGGATCCACCGGCTACGCCGATTCCGTGAAGG

GCAGGTTCACCATCAGCAGGGACAACGCCAAGAACTCCCTGTACCTGCA

GATGAACTCCCTGAGGGCCGAGGACACCGCCGTGTACTACTGCGCCAGG

GGCAGGTCCCTGCTGTTCGACTACTGGGGACAGGGCACCCTGGTGACCG

TGTCCAGG.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 207)
DCDIEGKDGKQYESVLMVSIDQLLDSMKEIGSNCLNNEFNFFKRHICDA

NKEGMFLFRAARKLRQFLKMNSTGDFDLHLLKVSEGTTILLNCTGQVKG

RKPAALGEAQPTKSLEENKSLKEQKKLNDLCFLKRLLQEIKTCWNKILM

GTKEHSGTTNTVAAYNLTWKSTNFKTILEWEPKPVNQVYTVQISTKSGD

WKSKCFYTTDTECDLTDEIVKDVKQTYLARVFSYPAGNVESTGSAGEPL

YENSPEFTPYLETNLGQPTIQSFEQVGTKVNVTVEDERTLVRRNNTFLS

LRDVFGKDLIYTLYYWKSSSSGKKTAKTNTNEFLIDVDKGENYCFSVQA

VIPSRTVNRKSTDSPVECMGQEKGEFRENWVNVISDLKKIEDLIQSMHI

DATLYTESDVHPSCKVTAMKCFLLELQVISLESGDASIHDTVENLIILA

NNSLSSNGNVTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 208)
GATTGCGACATCGAGGGCAAGGACGGCAAGCAGTACGAGAGCGTGCTGA

TGGTGTCCATCGACCAGCTGCTGGACAGCATGAAGGAGATCGGCTCCAA

CTGCCTCAACAACGAGTTCAACTTCTTCAAGCGGCACATCTGCGACGCC

AACAAGGAGGGCATGTTCCTGTTCAGGGCCGCCAGGAAACTGCGGCAGT

TCCTGAAGATGAACTCCACCGGCGACTTCGACCTGCACCTGCTGAAGGT

GTCCGAGGGCACCACCATCCTGCTGAACTGCACCGGACAGGTGAAGGGC

CGGAAACCTGCTGCTCTGGGAGAGGCCCAACCCACCAAGAGCCTGGAGG

AGAACAAGTCCCTGAAGGAGCAGAAGAAGCTGAACGACCTGTGCTTCCT

GAAGAGGCTGCTGCAGGAGATCAAGACCTGCTGGAACAAGATCCTGATG

GGCACCAAGGAGCATAGCGGCACAACCAACACAGTCGCTGCCTATAACC

TCACTTGGAAGAGCACCAACTTCAAAACCATCCTCGAATGGGAACCCAA

ACCCGTTAACCAAGTTTACACCGTGCAGATCAGCACCAAGTCCGGCGAC

TGGAAGTCCAAATGTTTCTATACCACCGACACCGAGTGCGATCTCACCG

ATGAGATCGTGAAAGATGTGAAACAGACCTACCTCGCCCGGGTGTTTAG

CTACCCCGCCGGCAATGTGGAGAGCACTGGTTCCGCTGGCGAGCCTTTA

TACGAGAACAGCCCCGAATTTACCCCTTACCTCGAGACCAATTTAGGAC

AGCCCACCATCCAAAGCTTTGAGCAAGTTGGCACAAAGGTGAATGTGAC

AGTGGAGGACGAGCGGACTTTAGTGCGGCGGAACAACACCTTTCTCAGC

CTCCGGGATGTGTTCGGCAAAGATTTAATCTACACACTGTATTACTGGA

AGTCCTCTTCCTCCGGCAAGAAGACAGCTAAAACCAACACAAACGAGTT

TTTAATCGACGTGGATAAAGGCGAAAACTACTGTTTCAGCGTGCAAGCT

GTGATCCCCTCCCGGACCGTGAATAGGAAAAGCACCGATAGCCCCGTTG

AGTGCATGGGCCAAGAAAAGGGCGAGTTCCGGGAGAACTGGGTGAACGT

CATCAGCGATTTAAAGAAGATCGAAGATTTAATTCAGTCCATGCATATC

GACGCCACTTTATACACAGAATCCGACGTGCACCCCTCTTGTAAGGTGA

CCGCCATGAAATGTTTTTTACTGGAGCTGCAAGTTATCTCTTTAGAGAG

CGGAGACGCTAGCATCCACGACACCGTGGGAGAATTTAATCATTTTAGCC

AATAACTCTTTATCCAGCAACGGCAACGTGACAGAGTCCGGCTGCAAGG

AGTGCGAAGAGCTGGAGGAGAAGAACATCAAGGAGTTTCTGCAATCCTT

TGTGCACATTGTCCAGATGTTCATCAATACCTCC.

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 209)
MKWVTFISLLFLFSSAYSDCDIEGKDGKQYESVLMVSIDQLLDSMKEIG

SNCLNNEFNFFKRHICDANKEGMFLFRAARKLRQFLKMNSTGDFDLHLL

KVSEGTTILLNCTGQVKGRKPAALGEAQPTKSLEENKSLKEQKKLNDLC

FLKRLLQEIKTCWNKILMGTKEHSGTTNTVAAYNLTWKSTNFKTILEWE

PKPVNQVYTVQISTKSGDWKSKCFYTTDTECDLTDEIVKDVKQTYLARV

FSYPAGNVESTGSAGEPLYENSPEFTPYLETNLGQPTIQSFEQVGTKVN

VTVEDERTLVRRNNTFLSLRDVFGKDLIYTLYYWKSSSSGKKTAKTNTN

EFLIDVDKGENYCFSVQAVIPSRTVNRKSTDSPVECMGQEKGEFRENWV

NVISDLKKIEDLIQSMHIDATLYTESDVHPSCKVTAMKCFLLELQVISL

ESGDASIHDTVENLIILANNSLSSNGNVTESGCKECEELEEKNIKEFLQ

SFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 210)
ATGAAGTGGGTGACCTTCATCAGCCTGCTGTTCCTGTTCTCCAGCGCCT

ACTCCGATTGCGACATCGAGGGCAAGGACGGCAAGCAGTACGAGAGCGT

-continued

```
GCTGATGGTGTCCATCGACCAGCTGCTGGACAGCATGAAGGAGATCGGC
TCCAACTGCCTCAACAACGAGTTCAACTTCTTCAAGCGGCACATCTGCG
ACGCCAACAAGGAGGGCATGTTCCTGTTCAGGGCCGCCAGGAAACTGCG
GCAGTTCCTGAAGATGAACTCCACCGGCGACTTCGACCTGCACCTGCTG
AAGGTGTCCGAGGGCACCACCATCCTGCTGAACTGCACCGGACAGGTGA
AGGGCCGGAAACCTGCTGCTCTGGGAGAGGCCCAACCCACCAAGAGCCT
GGAGGAGAACAAGTCCCTGAAGGAGCAGAAGAAGCTGAACGACCTGTGC
TTCCTGAAGAGGCTGCTGCAGGAGATCAAGACCTGCTGGAACAAGATCC
TGATGGGCACCAAGGAGCATAGCGGCACAACCAACACAGTCGCTGCCTA
TAACCTCACTTGGAAGAGCACCAACTTCAAAACCATCCTCGAATGGGAA
CCCAAACCCGTTAACCAAGTTTACACCGTGCAGATCAGCACCAAGTCCG
GCGACTGGAAGTCCAAATGTTTCTATACCACCGACACCGAGTGCGATCT
CACCGATGAGATCGTGAAAGATGTGAAACAGACCTACCTCGCCCGGGTG
TTTAGCTACCCCGCCGGCAATGTGGAGAGCACTGGTTCCGCTGGCGAGC
CTTTATACGAGAACAGCCCCGAATTTACCCCTTACCTCGAGACCAATTT
AGGACAGCCCACCATCCAAAGCTTTGAGCAAGTTGGCACAAAGGTGAAT
GTGACAGTGGAGGACGAGCGGACTTTAGTGCGGCGGAACAACACCTTTC
TCAGCCTCCGGGATGTGTTCGGCAAAGATTTAATCTACACACTGTATTA
CTGGAAGTCCTCTTCCTCCGGCAAGAAGACAGCTAAAACCAACACAAAC
GAGTTTTTAATCGACGTGGATAAAGGCGAAAACTACTGTTTCAGCGTGC
AAGCTGTGATCCCCTCCCGGACCGTGAATAGGAAAAGCACCGATAGCCC
CGTTGAGTGCATGGGCCAAGAAAAGGGCGAGTTCCGGGAGAACTGGGTG
AACGTCATCAGCGATTTAAAGAAGATCGAAGATTTAATTCAGTCCATGC
ATATCGACGCCACTTTATACACAGAATCCGACGTGCACCCCTCTTGTAA
GGTGACCGCCATGAAATGTTTTTTACTGGAGCTGCAAGTTATCTCTTTA
GAGAGCGGAGACGCTAGCATCCACGACACCGTGGAGAATTTAATCATTT
TAGCCAATAACTCTTTATCCAGCAACGGCAACGTGACAGAGTCCGGCTG
CAAGGAGTGCGAAGAGCTGGAGGAGAAGAACATCAAGGAGTTTCTGCAA
TCCTTTGTGCACATTGTCCAGATGTTCATCAATACCTCC.
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                         (SEQ ID NO: 232)
SELTQDPAVSVALGQTVRITCQGDSLRSYYASWYQQKPGQAPVLVIYGK
NNRPSGIPDRFSGSSSGNTASLTITGAQAEDEADYYCNSRDSSGNHVVF
GGGTKLTVGHGGGGSGGGGSGGGGSEVQLVESGGGVVRPGGSLRLSCAA
SGFTFDDYGMSWVRQAPGKGLEWVSGINWNGGSTGYADSVKGRFTISRD
NAKNSLYLQMNSLRAEDTAVYYCARGRSLLFDYWGQGTLVTVSRITCPP
PMSVEHADIWVKSYSLYSRERYICNSGFKRKAGTSSLTECVLNKATNVA
HWTTPSLKCIRQGQDRHMIRMRQLIDIVDQLKNYVNDLVPEFLPAPEDV
ETNCEWSAFSCFQKAQLKSANTGNNERIINVSIKKLKRKPPSTNAGRRQ
KHRLTCPSCDSYEKKPPKEFLERFKSLLQKMIHQHLSSRTHGSEDS.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                         (SEQ ID NO: 233)
TCCGAGCTGACCCAGGACCCTGCTGTGTCCGTGGCTCTGGGCCAGACCG
TGAGGATCACCTGCCAGGGCGACTCCCTGAGGTCCTACTACGCCTCCTG
GTACCAGCAGAAGCCCGGCCAGGCTCCTGTGCTGGTGATCTACGGCAAG
AACAACAGGCCCTCCGGCATCCCTGACAGGTTCTCCGGATCCTCCTCCG
GCAACACCGCCTCCCTGACCATCACAGGCGCTCAGGCCGAGGACGAGGC
TGACTACTACTGCAACTCCAGGGACTCCTCCGGCAACCATGTGGTGTTC
GGCGGCGGCACCAAGCTGACCGTGGGCCATGGCGGCGGCGGCTCCGGAG
GCGGCGGCAGCGGCGGAGGAGGATCCGAGGTGCAGCTGGTGGAGTCCGG
AGGAGGAGTGGTGAGGCCTGGAGGCTCCCTGAGGCTGAGCTGTGCTGCC
TCCGGCTTCACCTTCGACGACTACGGCATGTCCTGGGTGAGGCAGGCTC
CTGGAAAGGGCCTGGAGTGGGTGTCCGGCATCAACTGGAACGGCGGATC
CACCGGCTACGCCGATTCCGTGAAGGGCAGGTTCACCATCAGCAGGGAC
AACGCCAAGAACTCCCTGTACCTGCAGATGAACTCCCTGAGGGCCGAGG
ACACCGCCGTGTACTACTGCGCCAGGGGCAGGTCCCTGCTGTTCGACTA
CTGGGGACAGGGCACCCTGGTGACCGTGTCCAGGATTACATGCCCCCCT
CCCATGAGCGTGGAGCACGCCGACATCTGGGTGAAGAGCTATAGCCTCT
ACAGCCGGGAGAGGTATATCTGTAACAGCGGCTTCAAGAGGAAGGCCGG
CACCAGCAGCCTCACCGAGTGCGTGCTGAATAAGGCTACCAACGTGGCT
CACTGGACAACACCCTCTTTAAAGTGCATCCGGCAGGGCCAGGACAGGC
ACATGATCCGGATGAGGCAGCTCATCGACATCGTCGACCAGCTGAAGAA
CTACGTGAACGACCTGGTGCCCGAGTTTCTGCCTGCCCCCGAGGACGTG
GAGACCAACTGCGAGTGGTCCGCCTTCTCCTGCTTTCAGAAGGCCCAGC
TGAAGTCCGCCAACACCGGCAACAACGAGCGGATCATCAACGTGAGCAT
CAAGAAGCTGAAGCGGAAGCCTCCCTCCACAAACGCCGGCAGGAGGCAG
AAGCACAGGCTGACCTGCCCCAGCTGTGACTCCTACGAGAAGAAGCCCC
CCAAGGAGTTCCTGGAGAGGTTCAAGTCCCTGCTGCAGAAGATGATCCA
TCAGCACCTGTCCTCCAGGACCCACGGCTCCGAGGACTCC.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 234)
MKWVTFISLLFLFSSAYSSELTQDPAVSVALGQTVRITCQGDSLRSYYA

SWYQQKPGQAPVLVIYGKNNRPSGIPDRFSGSSSGNTASLTITGAQAED

EADYYCNSRDSSGNHVVFGGGTKLTVGHGGGGSGGGGSGGGGSEVQLVE

SGGGVVRPGGSLRLSCAASGFTFDDYGMSWVRQAPGKGLEWVSGINWNG

GSTGYADSVKGRFTISRDNAKNSLYLQMNSLRAEDTAVYYCARGRSLLF

DYWGQGTLVTVSRITCPPPMSVEHADIWVKSYSLYSRERYICNSGFKRK

AGTSSLTECVLNKATNVAHWTTPSLKCIRQGQDRHMIRMRQLIDIVDQL

KNYVNDLVPEFLPAPEDVETNCEWSAFSCFQKAQLKSANTGNNERIINV

SIKKLKRKPPSTNAGRRQKHRLTCPSCDSYEKKPPKEFLERFKSLLQKM

IHQHLSSRTHGSEDS.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 235)
ATGAAGTGGGTGACCTTCATCAGCCTGCTGTTCCTGTTCTCCAGCGCCT

ACTCCTCCGAGCTGACCCAGGACCCTGCTGTGTCCGTGGCTCTGGGCCA

GACCGTGAGGATCACCTGCCAGGGCGACTCCCTGAGGTCCTACTACGCC

TCCTGGTACCAGCAGAAGCCCGGCCAGGCTCCTGTGCTGGTGATCTACG

GCAAGAACAACAGGCCCTCCGGCATCCCTGACAGGTTCTCCGGATCCTC

CTCCGGCAACACCGCCTCCCTGACCATCACAGGCGCTCAGGCCGAGGAC

GAGGCTGACTACTACTGCAACTCCAGGGACTCCTCCGGCAACCATGTGG

TGTTCGGCGGCGGCACCAAGCTGACCGTGGGCCATGGCGGCGGCGGCTC

CGGAGGCGGCGGCAGCGGCGGAGGAGGATCCGAGGTGCAGCTGGTGGAG

TCCGGAGGAGGAGTGGTGAGGCCTGGAGGCTCCCTGAGGCTGAGCTGTG

CTGCCTCCGGCTTCACCTTCGACGACTACGGCATGTCCTGGGTGAGGCA

GGCTCCTGGAAAGGGCCTGGAGTGGGTGTCCGGCATCAACTGGAACGGC

GGATCCACCGGCTACGCCGATTCCGTGAAGGGCAGGTTCACCATCAGCA

GGGACAACGCCAAGAACTCCCTGTACCTGCAGATGAACTCCCTGAGGGC

CGAGGACACCGCCGTGTACTACTGCGCCAGGGGCAGGTCCCTGCTGTTC

GACTACTGGGGACAGGGCACCCTGGTGACCGTGTCCAGGATTACATGCC

CCCTCCCATGAGCGTGGAGCACGCCGACATCTGGGTGAAGAGCTATAG

CCTCTACAGCCGGGAGAGGTATATCTGTAACAGCGGCTTCAAGAGGAAG

GCCGGCACCAGCAGCCTCACCGAGTGCGTGCTGAATAAGGCTACCAACG

TGGCTCACTGGACAACACCCTCTTTAAAGTGCATCCGGCAGGGCCAGGA

CAGGCACATGATCCGGATGAGGCAGCTCATCGACATCGTCGACCAGCTG

AAGAACTACGTGAACGACCTGGTGCCCGAGTTTCTGCCTGCCCCCGAGG

ACGTGGAGACCAACTGCGAGTGGTCCGCCTTCTCCTGCTTTCAGAAGGC

CCAGCTGAAGTCCGCCAACACCGGCAACAACGAGCGGATCATCAACGTG

AGCATCAAGAAGCTGAAGCGGAAGCCTCCCTCCACAAACGCCGGCAGGA

GGCAGAAGCACAGGCTGACCTGCCCCAGCTGTGACTCCTACGAGAAGAA

GCCCCCCAAGGAGTTCCTGGAGAGGTTCAAGTCCCTGCTGCAGAAGATG

ATCCATCAGCACCTGTCCTCCAGGACCCACGGCTCCGAGGACTCC.

Exemplary Multi-Chain Chimeric Polypeptides—Type G

In some embodiments of any of the multi-chain chimeric polypeptides described herein, the first target-binding domain and the second targeting-binding domain each independently bind specifically to TGFβ (e.g., a human TGFβRII receptor), CD16 (e.g., an anti-CD16 scFv), or a receptor for IL-21 (e.g., a soluble human IL-21). In some embodiments of these multi-chain chimeric polypeptides described herein, the first chimeric polypeptide further includes the additional target-binding domain. In some embodiments of these multi-chain chimeric polypeptides described herein, the second chimeric polypeptide further includes the additional target-binding domain. In some embodiments of these multi-chain chimeric polypeptides described herein, the additional target-binding domain binds specifically to CD16 or a receptor for IL-21.

In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments, the second chimeric polypeptide further comprises one or more additional target-binding domains at the N-terminal end or the C-terminal end of the second chimeric polypeptide.

In some embodiments of these multi-chain chimeric polypeptides, the additional target-binding domain and the second domain of the pair of affinity domains directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the additional target-binding domain in the second chimeric polypeptide.

In some embodiments of these multi-chain chimeric polypeptides, the additional target-binding domain and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second target-binding domain and the additional target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, one or more of the first target-binding domain, the second target-binding domain and the additional antigen-binding domain is an agonistic antigen-binding domain. In some embodiments of these multi-chain chimeric polypeptides, the first target-binding domain, the second target-binding domain, and the additional antigen-binding domain are each agonistic antigen-binding domains. In some embodiments of these multi-chain chimeric polypeptides, the antigen-binding domain includes a scFv or single-domain antibody.

In some embodiments of any of the multi-chain chimeric polypeptides described herein, the first target-binding domain and the second targeting-binding domain each independently bind specifically to TGF-β, CD16, or a receptor for IL-21. In some embodiments of any of the multi-chain chimeric polypeptides described herein, the first target-binding domain binds specifically to a TGF-β and the second target-binding domain binds specifically to CD16 or a receptor of IL-21. In some embodiments of any of the multi-chain chimeric polypeptides described herein, the first target-binding domain is a soluble TGF-β receptor. In some embodiments of any of the multi-chain chimeric polypeptides described herein, soluble TGF-β receptor is a soluble TGFβRII receptor. In some embodiments of any of the multi-chain chimeric polypeptides described herein, the second target-binding domain binds specifically to CD16. In some embodiments of any of the multi-chain chimeric polypeptides described herein, the second antigen-binding domain includes an antigen-binding domain that binds specifically to CD16. In some embodiments of any of the multi-chain chimeric polypeptides described herein, the second antigen-binding domain includes an scFv that binds specifically to CD16. In some embodiments of any of the multi-chain chimeric polypeptides described herein, the second target-binding domain binds specifically to a receptor for IL-21. In some embodiments of any of the multi-chain chimeric polypeptides described herein, the second target-binding domain includes a soluble IL-21. In some embodiments of any of the multi-chain chimeric polypeptides described herein, the second target-binding domain includes a soluble human IL-21. In some embodiments of any of the multi-chain chimeric polypeptides described herein, the second chimeric polypeptide further includes an additional target-binding domain that binds specifically to a receptor for IL-21. In some embodiments of any of the multi-chain chimeric polypeptides described herein, the additional target-binding domain includes a soluble IL-21. In some embodiments of any of the multi-chain chimeric polypeptides described herein, the soluble IL-21 is a soluble human IL-21. In some embodiments of any of the multi-chain chimeric polypeptides described herein, the second chimeric polypeptide further includes an additional target-binding domain that binds specifically to CD16.

In some embodiments of these multi-chain chimeric polypeptides, two or more of the first target-binding domain, the second target-binding domain, and the one or more additional target-binding domains bind specifically to the same antigen. In some embodiments, two or more of the first target-binding domain, the second target-binding domain, and the one or more additional target-binding domains bind specifically to the same epitope. In some embodiments, two or more of the first target-binding domain, the second target-binding domain, and the one or more additional target-binding domains comprise the same amino acid sequence.

In some embodiments of these multi-chain chimeric polypeptides, the first target-binding domain includes a TGFβRII receptor (e.g., a soluble human TGFβRII receptor). In some embodiments of these multi-chain chimeric polypeptides, the soluble human TGFRβRII includes a first sequence of soluble human TGFRβRII and a second sequence of soluble human TGFRβRII. In some embodiments of these multi-chain chimeric polypeptides, the soluble human TGFRβRII includes a linker disposed between the first sequence of soluble human TGFRβRII and the second sequence of soluble human TGFRβRII. In some examples of these multi-chain chimeric polypeptides, the linker includes the sequence GGGGSGGGGSGGGGS (SEQ ID NO: 102).

In some embodiments of these multi-chain chimeric polypeptides, the first sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 183)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPD.

In some embodiments of these multi-chain chimeric polypeptides, the second sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 184)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPD.

In some embodiments of these multi-chain chimeric polypeptides, the first sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 185)
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCAGC

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCCAAATGC

ATCATGAAGGAGAAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGAT.

In some embodiments of these multi-chain chimeric polypeptides, the second sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 186)
ATTCCTCCCCACGTGCAGAAGAGCGTGAATAATGACATGATCGTGACCG

ATAACAATGGCGCCGTGAAATTTCCCCAGCTGTGCAAATTCTGCGATGT

GAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGC

GGAAGAATGACGAGAATATCACCCTGGAAACCGTCTGCCACGATCCCAA

GCTGCCCTACCACGATTTCATCCTGGAAGACGCCGCCAGCCCTAAGTGC

ATCATGAAAGAGAAAAAGAAGCCTGGCGAGACCTTTTTCATGTGCTCCT

GCAGCAGCGACGAATGCAACGACAATATCATCTTTAGCGAGGAATACAA

TACCAGCAACCCCGAC.

In some embodiments of these multi-chain chimeric polypeptides, the soluble TGF-β receptor includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 188)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPDGGGGSGGGGSG

GGGSIPPHVQKSVNNDMIVTDNNGAVKFPQLCKFCDVRFSTCDNQKSCM

SNCSITSICEKPQEVCVAVWRKNDENITLETVCHDPKLPYHDFILEDAA

SPKCIMKEKKKPGETFFMCSCSSDECNDNIIFSEEYNTSNPD.

In some embodiments of these multi-chain chimeric polypeptides, the soluble human TGFβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 187)
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCAGC

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCCAAATGC

ATCATGAAGGAGAAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGATGGAGGTGGCGGATCCGGAGGTGGAGGTTCTGGT

GGAGGTGGGAGTATTCCTCCCCACGTGCAGAAGAGCGTGAATAATGACA

TGATCGTGACCGATAACAATGGCGCCGTGAAATTTCCCCAGCTGTGCAA

ATTCTGCGATGTGAGGTTTTCCACCTGCGACAACCAGAAGTCCTGTATG

AGCAACTGCTCCATCACCTCCATCTGTGAGAAGCCTCAGGAGGTGTGCG

TGGCTGTCTGGCGGAAGAATGACGAGAATATCACCCTGGAAACCGTCTG

CCACGATCCCAAGCTGCCCTACCACGATTTCATCCTGGAAGACGCCGCC

AGCCCTAAGTGCATCATGAAAGAGAAAAAGAAGCCTGGCGAGACCTTTT

TCATGTGCTCCTGCAGCAGCGACGAATGCAACGACAATATCATCTTTAG

CGAGGAATACAATACCAGCAACCCCGAC.

In some embodiments of these multi-chain chimeric polypeptides, the sequence of soluble human IL-21 comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 83)
QGQDRHMIRMRQLIDIVDQLKNYVNDLVPEFLPAPEDVETNCEWSAFSC

FQKAQLKSANTGNNERIINVSIKKLKRKPPSTNAGRRQKHRLTCPSCDS

YEKKPPKEFLERFKSLLQKMIHQHLSSRTHGSEDS.

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 197)
CAAGGTCAAGATCGCCACATGATTAGAATGCGTCAACTTATAGATATTG

TTGATCAGCTGAAAAATTATGTGAATGACTTGGTCCCTGAATTTCTGCC

AGCTCCAGAAGATGTAGAGACAAACTGTGAGTGGTCAGCTTTTTCCTGT

TTTCAGAAGGCCCAACTAAAGTCAGCAAATACAGGAAACAATGAAAGGA

TAATCAATGTATCAATTAAAAAGCTGAAGAGGAAACCACCTTCCACAAA

TGCAGGGAGAAGACAGAAACACAGACTAACATGCCCTTCATGTGATTCT

TATGAGAAAAAACCACCCAAAGAATTCCTAGAAAGATTCAAATCACTTC

TCCAAAAGATGATTCATCAGCATCTGTCCTCTAGAACACACGGAAGTGA

AGATTCC.

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 182)
CAGGGCCAGGACAGGCACATGATCCGGATGAGGCAGCTCATCGACATCG

TCGACCAGCTGAAGAACTACGTGAACGACCTGGTGCCCGAGTTTCTGCC

TGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGA

TCATCAACGTGAGCATCAAGAAGCTGAAGCGGAAGCCTCCCTCCACAAA

CGCCGGCAGGAGGCAGAAGCACAGGCTGACCTGCCCCAGCTGTGACTCC

TACGAGAAGAAGCCCCCCAAGGAGTTCCTGGAGAGGTTCAAGTCCCTGC

TGCAGAAGATGATCCATCAGCACCTGTCCTCCAGGACCCACGGCTCCGA

GGACTCC.

In some embodiments of these multi-chain chimeric polypeptides, the scFv that binds specifically to CD16 includes a light chain variable domain that includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 215)
SELTQDPAVSVALGQTVRITCQGDSLRSYYASWYQQKPGQAPVLVIYGK

NNRPSGIPDRFSGSSSGNTASLTITGAQAEDEADYYCNSRDSSGNHVVF

GGGTKLTVGH.

In some embodiments of these multi-chain chimeric polypeptides, the scFv that binds specifically to CD16 is encoded by a light chain variable domain sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 216)
TCCGAGCTGACCCAGGACCCTGCTGTGTCCGTGGCTCTGGGCCAGACCGT

GAGGATCACCTGCCAGGGCGACTCCCTGAGGTCCTACTACGCCTCCTGGT

ACCAGCAGAAGCCCGGCCAGGCTCCTGTGCTGGTGATCTACGGCAAGAAC

AACAGGCCCTCCGGCATCCCTGACAGGTTCTCCGGATCCTCCTCCGGCAA

CACCGCCTCCCTGACCATCACAGGCGCTCAGGCCGAGGACGAGGCTGACT

ACTACTGCAACTCCAGGGACTCCTCCGGCAACCATGTGGTGTTCGGCGGC

GGCACCAAGCTGACCGTGGGCCAT.

In some embodiments of these multi-chain chimeric polypeptides, the scFv that binds specifically to CD16 includes a heavy chain variable domain that includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 217)
EVQLVESGGGVVRPGGSLRLSCAASGFTFDDYGMSWVRQAPGKGLEWVSG

INWNGGSTGYADSVKGRFTISRDNAKNSLYLQMNSLRAEDTAVYYCARGR

SLLFDYWGQGTLVTVSR.

In some embodiments of these multi-chain chimeric polypeptides, the scFv that binds specifically to CD16 is encoded by a heavy chain variable domain sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 218)
GAGGTGCAGCTGGTGGAGTCCGGAGGAGGAGTGGTGAGGCCTGGAGGCTC

CCTGAGGCTGAGCTGTGCTGCCTCCGGCTTCACCTTCGACGACTACGGCA

TGTCCTGGGTGAGGCAGGCTCCTGGAAAGGGCCTGGAGTGGGTGTCCGGC

ATCAACTGGAACGGCGGATCCACCGGCTACGCCGATTCCGTGAAGGGCAG

GTTCACCATCAGCAGGGACAACGCCAAGAACTCCCTGTACCTGCAGATGA

ACTCCCTGAGGGCCGAGGACACCGCCGTGTACTACTGCGCCAGGGGCAGG

TCCCTGCTGTTCGACTACTGGGGACAGGGCACCCTGGTGACCGTGTCCAG

G.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 236)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPDSGTTNTVAAYNLT

WKSTNFKTILEWEPKPVNQVYTVQISTKSGDWKSKCFYTTDTECDLTDEI

VKDVKQTYLARVFSYPAGNVESTGSAGEPLYENSPEFTPYLETNLGQPTI

QSFEQVGTKVNVTVEDERTLVRRNNTFLSLRDVFGKDLIYTLYYWKSSSS

GKKTAKTNTNEFLIDVDKGENYCFSVQAVIPSRTVNRKSTDSPVECMGQE

KGEFRENWVNVISDLKKIEDLIQSMHIDATLYTESDVHPSCKVTAMKCFL

LELQVISLESGDASIHDTVENLIILANNSLSSNGNVTESGCKECEELEEK

NIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 237)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGACAGCGGCACAACCAACACAGTCGCTGCCTATAACCTCACT

TGGAAGAGCACCAACTTCAAAACCATCCTCGAATGGGAACCCAAACCCGT

TAACCAAGTTTACACCGTGCAGATCAGCACCAAGTCCGGCGACTGGAAGT

CCAAATGTTTCTATACCACCGACACCGAGTGCGATCTCACCGATGAGATC

GTGAAAGATGTGAAACAGACCTACCTCGCCCGGGTGTTTAGCTACCCCGC

CGGCAATGTGGAGAGCACTGGTTCCGCTGGCGAGCCTTTATACGAGAACA

GCCCCGAATTTACCCCTTACCTCGAGACCAATTTAGGACAGCCCACCATC

CAAAGCTTTGAGCAAGTTGGCACAAAGGTGAATGTGACAGTGGAGGACGA

GCGGACTTTAGTGCGGCGGAACAACACCTTTCTCAGCCTCCGGGATGTGT

TCGGCAAAGATTTAATCTACACACTGTATTACTGGAAGTCCTCTTCCTCC

GGCAAGAAGACAGCTAAAACCAACACAAACGAGTTTTTAATCGACGTGGA

TAAAGGCGAAAACTACTGTTTCAGCGTGCAAGCTGTGATCCCCTCCCGGA

CCGTGAATAGGAAAAGCACCGATAGCCCCGTTGAGTGCATGGGCCAAGAA

AAGGGCGAGTTCCGGGAGAACTGGGTGAACGTCATCAGCGATTTAAAGAA

GATCGAAGATTTAATTCAGTCCATGCATATCGACGCCACTTTATACACAG

AATCCGACGTGCACCCCTCTTGTAAGGTGACCGCCATGAAATGTTTTTTA

CTGGAGCTGCAAGTTATCTCTTTAGAGAGCGGAGACGCTAGCATCCACGA

CACCGTGGAGAATTTAATCATTTTAGCCAATAACTCTTTATCCAGCAACG

GCAACGTGACAGAGTCCGGCTGCAAGGAGTGCGAAGAGCTGGAGGAGAAG

AACATCAAGGAGTTTCTGCAATCCTTTGTGCACATTGTCCAGATGTTCAT

CAATACCTCC.

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 238)
MKWVTFISLLFLFSSAYSIPPHVQKSVNNDMIVTDNNGAVKFPQLCKFCD

VRFSTCDNQKSCMSNCSITSICEKPQEVCVAVWRKNDENITLETVCHDPK

LPYHDFILEDAASPKCIMKEKKKPGETFFMCSCSSDECNDNIIFSEEYNT

SNPDGGGGSGGGGSGGGGSIPPHVQKSVNNDMIVTDNNGAVKFPQLCKFC

DVRFSTCDNQKSCMSNCSITSICEKPQEVCVAVWRKNDENITLETVCHDP

KLPYHDFILEDAASPKCIMKEKKKPGETFFMCSCSSDECNDNIIFSEEYN

TSNPDSGTTNTVAAYNLTWKSTNFKTILEWEPKPVNQVYTVQISTKSGDW

KSKCFYTTDTECDLTDEIVKDVKQTYLARVFSYPAGNVESTGSAGEPLYE

NSPEFTPYLETNLGQPTIQSFEQVGTKVNVTVEDERTLVRRNNTFLSLRD

VFGKDLIYTLYYWKSSSSGKKTAKTNTNEFLIDVDKGENYCFSVQAVIPS

RTVNRKSTDSPVECMGQEKGEFRENWVNVISDLKKIEDLIQSMHIDATLY

TESDVHPSCKVTAMKCFLLELQVISLESGDASIHDTVENLIILANNSLSS

NGNVTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 239)
ATGAAGTGGGTGACCTTCATCAGCCTGCTGTTCCTGTTCTCCAGCGCCTA

CTCCATCCCCCCCATGTGCAAAAGAGCGTGAACAACGATATGATCGTGA

CCGACAACAACGGCGCCGTGAAGTTTCCCCAGCTCTGCAAGTTCTGCGAT

GTCAGGTTCAGCACCTGCGATAATCAGAAGTCCTGCATGTCCAACTGCAG

CATCACCTCCATCTGCGAGAAGCCCCAAGAAGTGTGCGTGGCCGTGTGGC

GGAAAAATGACGAGAACATCACCCTGGAGACCGTGTGTCACGACCCCAAG

```
CTCCCTTATCACGACTTCATTCTGGAGGACGCTGCCTCCCCCAAATGCAT
CATGAAGGAGAAGAAGAAGCCCGGAGAGACCTTCTTTATGTGTTCCTGTA
GCAGCGACGAGTGTAACGACAACATCATCTTCAGCGAAGAGTACAACACC
AGCAACCCTGATGGAGGTGGCGGATCCGGAGGTGGAGGTTCTGGTGGAGG
TGGGAGTATTCCTCCCCACGTGCAGAAGAGCGTGAATAATGACATGATCG
TGACCGATAACAATGGCGCCGTGAAATTTCCCCAGCTGTGCAAATTCTGC
GATGTGAGGTTTTCCACCTGCGACAACCAGAAGTCCTGTATGAGCAACTG
CTCCATCACCTCCATCTGTGAGAAGCCTCAGGAGGTGTGCGTGGCTGTCT
GGCGGAAGAATGACGAGAATATCACCCTGGAAACCGTCTGCCACGATCCC
AAGCTGCCCTACCACGATTTCATCCTGGAAGACGCCGCCAGCCCTAAGTG
CATCATGAAAGAGAAAAAGAAGCCTGGCGAGACCTTTTTCATGTGCTCCT
GCAGCAGCGACGAATGCAACGACAATATCATCTTTAGCGAGGAATACAAT
ACCAGCAACCCCGACAGCGGCACAACCAACACAGTCGCTGCCTATAACCT
CACTTGGAAGAGCACCAACTTCAAAACCATCCTCGAATGGGAACCCAAAC
CCGTTAACCAAGTTTACACCGTGCAGATCAGCACCAAGTCCGGCGACTGG
AAGTCCAAATGTTTCTATACCACCGACACCGAGTGCGATCTCACCGATGA
GATCGTGAAAGATGTGAAACAGACCTACCTCGCCCGGGTGTTTAGCTACC
CCGCCGGCAATGTGGAGAGCACTGGTTCCGCTGGCGAGCCTTTATACGAG
AACAGCCCCGAATTTACCCCTTACCTCGAGACCAATTTAGGACAGCCCAC
CATCCAAAGCTTTGAGCAAGTTGGCACAAAGGTGAATGTGACAGTGGAGG
ACGAGCGGACTTTAGTGCGGCGGAACAACACCTTTCTCAGCCTCCGGGAT
GTGTTCGGCAAAGATTTAATCTACACACTGTATTACTGGAAGTCCTCTTC
CTCCGGCAAGAAGACAGCTAAAACCAACACAAACGAGTTTTTAATCGACG
TGGATAAAGGCGAAAACTACTGTTTCAGCGTGCAAGCTGTGATCCCCTCC
CGGACCGTGAATAGGAAAAGCACCGATAGCCCCGTTGAGTGCATGGGCCA
AGAAAAGGGCGAGTTCCGGGAGAACTGGGTGAACGTCATCAGCGATTTAA
AGAAGATCGAAGATTTAATTCAGTCCATGCATATCGACGCCACTTTATAC
ACAGAATCCGACGTGCACCCCTCTTGTAAGGTGACCGCCATGAAATGTTT
TTTACTGGAGCTGCAAGTTATCTCTTTAGAGAGCGGAGACGCTAGCATCC
ACGACACCGTGGAGAATTTAATCATTTTAGCCAATAACTCTTTATCCAGC
AACGGCAACGTGACAGAGTCCGGCTGCAAGGAGTGCGAAGAGCTGGAGGA
GAAGAACATCAAGGAGTTTCTGCAATCCTTTGTGCACATTGTCCAGATGT
TCATCAATACCTCC.
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 232)
SELTQDPAVSVALGQTVRITCQGDSLRSYYASWYQQKPGQAPVLVIYGKN
NRPSGIPDRFSGSSSGNTASLTITGAQAEDEADYYCNSRDSSGNHVVFGG
GTKLTVGHGGGGSGGGGSGGGGSEVQLVESGGGVVRPGGSLRLSCAASGF
TFDDYGMSWVRQAPGKGLEWVSGINWNGGSTGYADSVKGRFTISRDNAKN
SLYLQMNSLRAEDTAVYYCARGRSLLFDYWGQGTLVTVSRITCPPPMSVE
HADIWVKSYSLYSRERYICNSGFKRKAGTSSLTECVLNKATNVAHWTTPS
LKCIRQGQDRHMIRMRQLIDIVDQLKNYVNDLVPEFLPAPEDVETNCEWS
AFSCFQKAQLKSANTGNNERIINVSIKKLKRKPPSTNAGRRQKHRLTCPS
CDSYEKKPPKEFLERFKSLLQKMIHQHLSSRTHGSEDS.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                    (SEQ ID NO: 233)
TCCGAGCTGACCCAGGACCCTGCTGTGTCCGTGGCTCTGGGCCAGACCGT
GAGGATCACCTGCCAGGGCGACTCCCTGAGGTCCTACTACGCCTCCTGGT
ACCAGCAGAAGCCCGGCCAGGCTCCTGTGCTGGTGATCTACGGCAAGAAC
AACAGGCCCTCCGGCATCCCTGACAGGTTCTCCGGATCCTCCTCCGGCAA
CACCGCCTCCCTGACCATCACAGGCGCTCAGGCCGAGGACGAGGCTGACT
ACTACTGCAACTCCAGGGACTCCTCCGGCAACCATGTGGTGTTCGGCGGC
GGCACCAAGCTGACCGTGGGCCATGGCGGCGGCGGCTCCGGAGGCGGCGG
CAGCGGCGGAGGAGGATCCGAGGTGCAGCTGGTGGAGTCCGGAGGAGGAG
TGGTGAGGCCTGGAGGCTCCCTGAGGCTGAGCTGTGCTGCCTCCGGCTTC
ACCTTCGACGACTACGGCATGTCCTGGGTGAGGCAGGCTCCTGGAAAGGG
CCTGGAGTGGGTGTCCGGCATCAACTGGAACGGCGGATCCACCGGCTACG
CCGATTCCGTGAAGGGCAGGTTCACCATCAGCAGGGACAACGCCAAGAAC
TCCCTGTACCTGCAGATGAACTCCCTGAGGGCCGAGGACACCGCCGTGTA
CTACTGCGCCAGGGGCAGGTCCCTGCTGTTCGACTACTGGGGACAGGGCA
CCCTGGTGACCGTGTCCAGGATTACATGCCCCCCTCCCATGAGCGTGGAG
CACGCCGACATCTGGGTGAAGAGCTATAGCCTCTACAGCCGGGAGAGGTA
TATCTGTAACAGCGGCTTCAAGAGGAAGGCCGGCACCAGCAGCCTCACCG
AGTGCGTGCTGAATAAGGCTACCAACGTGGCTCACTGGACAACACCCTCT
TTAAAGTGCATCCGGCAGGGCCAGGACAGGCACATGATCCGGATGAGGCA
GCTCATCGACATCGTCGACCAGCTGAAGAACTACGTGAACGACCTGGTGC
CCGAGTTTCTGCCTGCCCCCGAGGACGTGGAGACCAACTGCGAGTGGTCC
GCCTTCTCCTGCTTTCAGAAGGCCCAGCTGAAGTCCGCCAACACCGGCAA
CAACGAGCGGATCATCAACGTGAGCATCAAGAAGCTGAAGCGGAAGCCTC
CCTCCACAAACGCCGGCAGGAGGCAGAAGCACAGGCTGACCTGCCCCAGC
TGTGACTCCTACGAGAAGAAGCCCCCCAAGGAGTTCCTGGAGAGGTTCAA
GTCCCTGCTGCAGAAGATGATCCATCAGCACCTGTCCTCCAGGACCCACG
GCTCCGAGGACTCC.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 234)
MKWVTFISLLFLFSSAYSSELTQDPAVSVALGQTVRITCQGDSLRSYYAS

WYQQKPGQAPVLVIYGKNNRPSGIPDRFSGSSSGNTASLTITGAQAEDEA

DYYCNSRDSSGNHVVFGGGTKLTVGHGGGGSGGGGSGGGGSEVQLVESGG

GVVRPGGSLRLSCAASGFTFDDYGMSWVRQAPGKGLEWVSGINWNGGSTG

YADSVKGRFTISRDNAKNSLYLQMNSLRAEDTAVYYCARGRSLLFDYWGQ

GTLVTVSRITCPPPMSVEHADIWVKSYSLYSRERYICNSGFKRKAGTSSL

TECVLNKATNVAHWTTPSLKCIRQGQDRHMIRMRQLIDIVDQLKNYVNDL

VPEFLPAPEDVETNCEWSAFSCFQKAQLKSANTGNNERIINVSIKKLKRK

PPSTNAGRRQKHRLTCPSCDSYEKKPPKEFLERFKSLLQKMIHQHLSSRT

HGSEDS.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 235)
ATGAAGTGGGTGACCTTCATCAGCCTGCTGTTCCTGTTCTCCAGCGCCTA

CTCCTCCGAGCTGACCCAGGACCCTGCTGTGTCCGTGGCTCTGGGCCAGA

CCGTGAGGATCACCTGCCAGGGCGACTCCCTGAGGTCCTACTACGCCTCC

TGGTACCAGCAGAAGCCCGGCCAGGCTCCTGTGCTGGTGATCTACGGCAA

GAACAACAGGCCCTCCGGCATCCCTGACAGGTTCTCCGGATCCTCCTCCG

GCAACACCGCCTCCCTGACCATCACAGGCGCTCAGGCCGAGGACGAGGCT

GACTACTACTGCAACTCCAGGGACTCCTCCGGCAACCATGTGGTGTTCGG

CGGCGGCACCAAGCTGACCGTGGGCCATGGCGGCGGCGGCTCCGGAGGCG

GCGGCAGCGGCGGAGGAGGATCCGAGGTGCAGCTGGTGGAGTCCGGAGGA

GGAGTGGTGAGGCCTGGAGGCTCCCTGAGGCTGAGCTGTGCTGCCTCCGG

CTTCACCTTCGACGACTACGGCATGTCCTGGGTGAGGCAGGCTCCTGGAA

AGGGCCTGGAGTGGGTGTCCGGCATCAACTGGAACGGCGGATCCACCGGC

TACGCCGATTCCGTGAAGGGCAGGTTCACCATCAGCAGGGACAACGCCAA

GAACTCCCTGTACCTGCAGATGAACTCCCTGAGGGCCGAGGACACCGCCG

TGTACTACTGCGCCAGGGGCAGGTCCCTGCTGTTCGACTACTGGGGACAG

GGCACCCTGGTGACCGTGTCCAGGATTACATGCCCCCCTCCCATGAGCGT

GGAGCACGCCGACATCTGGGTGAAGAGCTATAGCCTCTACAGCCGGGAGA

GGTATATCTGTAACAGCGGCTTCAAGAGGAAGGCCGGCACCAGCAGCCTC

ACCGAGTGCGTGCTGAATAAGGCTACCAACGTGGCTCACTGGACAACACC

CTCTTTAAAGTGCATCCGGCAGGGCCAGGACAGGCACATGATCCGGATGA

GGCAGCTCATCGACATCGTCGACCAGCTGAAGAACTACGTGAACGACCTG

GTGCCCGAGTTTCTGCCTGCCCCCGAGGACGTGGAGACCAACTGCGAGTG

GTCCGCCTTCTCCTGCTTTCAGAAGGCCCAGCTGAAGTCCGCCAACACCG

GCAACAACGAGCGGATCATCAACGTGAGCATCAAGAAGCTGAAGCGGAAG

CCTCCCTCCACAAACGCCGGCAGGAGGCAGAAGCACAGGCTGACCTGCCC

CAGCTGTGACTCCTACGAGAAGAAGCCCCCCAAGGAGTTCCTGGAGAGGT

TCAAGTCCCTGCTGCAGAAGATGATCCATCAGCACCTGTCCTCCAGGACC

CACGGCTCCGAGGACTCC.

Exemplary Multi-Chain Chimeric Polypeptides—Type H

In some embodiments of any of the multi-chain chimeric polypeptides described herein, the first target-binding domain and the second targeting-binding domain each independently bind specifically to a receptor of IL-7. In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, the first target-binding domain and the second target-binding domain each independently bind specifically to a receptor for IL-7. In some embodiments of these multi-chain chimeric polypeptides, the first target-binding domain and the second target-binding domain bind specifically to the same epitope. In some embodiments of these multi-chain chimeric polypeptides, the first target-binding domain and the second target-binding domain include the same amino acid sequence.

In some embodiments of these multi-chain chimeric polypeptides, the first target-binding domain and the second target-binding domain include a soluble IL-7 (e.g., a soluble human IL-7). In some embodiments of these multi-chain chimeric polypeptides, the soluble human IL-7 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 79)
DCDIEGKDGKQYESVLMVSIDQLLDSMKEIGSNCLNNEFNFFKRHICDAN

KEGMPLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EH.

In some embodiments of these multi-chain chimeric polypeptides, the soluble human IL-7 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 227)
GATTGCGACATCGAGGGCAAGGACGGCAAGCAGTACGAGAGCGTGCTGAT

GGTGTCCATCGACCAGCTGCTGGACAGCATGAAGGAGATCGGCTCCAACT

GCCTCAACAACGAGTTCAACTTCTTCAAGCGGCACATCTGCGACGCCAAC

AAGGAGGGCATGTTCCTGTTCAGGGCCGCCAGGAAACTGCGGCAGTTCCT

GAAGATGAACTCCACCGGCGACTTCGACCTGCACCTGCTGAAGGTGTCCG

AGGGCACCACCATCCTGCTGAACTGCACCGGACAGGTGAAGGGCCGGAAA

CCTGCTGCTCTGGGAGAGGCCCAACCCACCAAGAGCCTGGAGGAGAACAA

GTCCCTGAAGGAGCAGAAGAAGCTGAACGACCTGTGCTTCCTGAAGAGGC

TGCTGCAGGAGATCAAGACCTGCTGGAACAAGATCCTGATGGGCACCAAG

GAGCAT.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 207)
DCDIEGKDGKQYESVLMVSIDQLLDSMKEIGSNCLNNEFNFFKRHICDAN

KEGMPLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EHSGTTNTVAAYNLTWKSTNFKTILEWEPKPVNQVYTVQISTKSGDWKSK

CFYTTDTECDLTDEIVKDVKQTYLARVFSYPAGNVESTGSAGEPLYENSP

EFTPYLETNLGQPTIQSFEQVGTKVNVTVEDERTLVRRNNTFLSLRDVFG

KDLIYTLYYWKSSSSGKKTAKTNTNEFLIDVDKGENYCFSVQAVIPSRTV

NRKSTDSPVECMGQEKGEFRENWVNVISDLKKIEDLIQSMHIDATLYTES

DVHPSCKVTAMKCFLLELQVISLESGDASIHDTVENLIILANNSLSSNGN

VTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 208)
GATTGCGACATCGAGGGCAAGGACGGCAAGCAGTACGAGAGCGTGCTGAT

GGTGTCCATCGACCAGCTGCTGGACAGCATGAAGGAGATCGGCTCCAACT

GCCTCAACAACGAGTTCAACTTCTTCAAGCGGCACATCTGCGACGCCAAC

AAGGAGGGCATGTTCCTGTTCAGGGCCGCCAGGAAACTGCGGCAGTTCCT

GAAGATGAACTCCACCGGCGACTTCGACCTGCACCTGCTGAAGGTGTCCG

AGGGCACCACCATCCTGCTGAACTGCACCGGACAGGTGAAGGGCCGGAAA

CCTGCTGCTCTGGGAGAGGCCCAACCCACCAAGAGCCTGGAGGAGAACAA

GTCCCTGAAGGAGCAGAAGAAGCTGAACGACCTGTGCTTCCTGAAGAGGC

TGCTGCAGGAGATCAAGACCTGCTGGAACAAGATCCTGATGGGCACCAAG

GAGCATAGCGGCACAACCAACACAGTCGCTGCCTATAACCTCACTTGGAA

GAGCACCAACTTCAAAACCATCCTCGAATGGGAACCCAAACCCGTTAACC

AAGTTTACACCGTGCAGATCAGCACCAAGTCCGGCGACTGGAAGTCCAAA

TGTTTCTATACCACCGACACCGAGTGCGATCTCACCGATGAGATCGTGAA

AGATGTGAAACAGACCTACCTCGCCCGGGTGTTTAGCTACCCCGCCGGCA

ATGTGGAGAGCACTGGTTCCGCTGGCGAGCCTTTATACGAGAACAGCCCC

GAATTTACCCCTTACCTCGAGACCAATTTAGGACAGCCCACCATCCAAAG

CTTTGAGCAAGTTGGCACAAAGGTGAATGTGACAGTGGAGGACGAGCGGA

CTTTAGTGCGGCGGAACAACACCTTTCTCAGCCTCCGGGATGTGTTCGGC

AAAGATTTAATCTACACACTGTATTACTGGAAGTCCTCTTCCTCCGGCAA

GAAGACAGCTAAAACCAACACAAACGAGTTTTTAATCGACGTGGATAAAG

GCGAAAACTACTGTTTCAGCGTGCAAGCTGTGATCCCCTCCCGGACCGTG

AATAGGAAAAGCACCGATAGCCCCGTTGAGTGCATGGGCCAAGAAAAGGG

CGAGTTCCGGGAGAACTGGGTGAACGTCATCAGCGATTTAAAGAAGATCG

AAGATTTAATTCAGTCCATGCATATCGACGCCACTTTATACACAGAATCC

GACGTGCACCCCTCTTGTAAGGTGACCGCCATGAAATGTTTTTTACTGGA

GCTGCAAGTTATCTCTTTAGAGAGCGGAGACGCTAGCATCCACGACACCG

TGGAGAATTTAATCATTTTAGCCAATAACTCTTTATCCAGCAACGGCAAC

GTGACAGAGTCCGGCTGCAAGGAGTGCGAAGAGCTGGAGGAGAAGAACAT

CAAGGAGTTTCTGCAATCCTTTGTGCACATTGTCCAGATGTTCATCAATA

CCTCC.

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 209)
MKWVTFISLLFLFSSAYSDCDIEGKDGKQYESVLMVSIDQLLDSMKEIGS

NCLNNEFNFFKRHICDANKEGMFLFRAARKLRQFLKMNSTGDFDLHLLKV

SEGTTILLNCTGQVKGRKPAALGEAQPTKSLEENKSLKEQKKLNDLCFLK

RLLQEIKTCWNKILMGTKEHSGTTNTVAAYNLTWKSTNFKTILEWEPKPV

NQVYTVQISTKSGDWKSKCFYTTDTECDLTDEIVKDVKQTYLARVFSYPA

GNVESTGSAGEPLYENSPEFTPYLETNLGQPTIQSFEQVGTKVNVTVEDE

RTLVRRNNTFLSLRDVFGKDLIYTLYYWKSSSSGKKTAKTNTNEFLIDVD

KGENYCFSVQAVIPSRTVNRKSTDSPVECMGQEKGEFRENWVNVISDLKK

IEDLIQSMHIDATLYTESDVHPSCKVTAMKCFLLELQVISLESGDASIHD

TVENLIILANNSLSSNGNVTESGCKECEELEEKNIKEFLQSFVHIVQMFI

NTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 210)
ATGAAGTGGGTGACCTTCATCAGCCTGCTGTTCCTGTTCTCCAGCGCCTA

CTCCGATTGCGACATCGAGGGCAAGGACGGCAAGCAGTACGAGAGCGTGC

TGATGGTGTCCATCGACCAGCTGCTGGACAGCATGAAGGAGATCGGCTCC

AACTGCCTCAACAACGAGTTCAACTTCTTCAAGCGGCACATCTGCGACGC

CAACAAGGAGGGCATGTTCCTGTTCAGGGCCGCCAGGAAACTGCGGCAGT

TCCTGAAGATGAACTCCACCGGCGACTTCGACCTGCACCTGCTGAAGGTG

TCCGAGGGCACCACCATCCTGCTGAACTGCACCGGACAGGTGAAGGGCCG

GAAACCTGCTGCTCTGGGAGAGGCCCAACCCCACCAAGAGCCTGGAGGAGA

ACAAGTCCCTGAAGGAGCAGAAGAAGCTGAACGACCTGTGCTTCCTGAAG

AGGCTGCTGCAGGAGATCAAGACCTGCTGGAACAAGATCCTGATGGGCAC

CAAGGAGCATAGCGGCACAACCAACACAGTCGCTGCCTATAACCTCACTT

GGAAGAGCACCAACTTCAAAACCATCCTCGAATGGGAACCCAAACCCGTT

AACCAAGTTTACACCGTGCAGATCAGCACCAAGTCCGGCGACTGGAAGTC

CAAATGTTTCTATACCACCGACACCGAGTGCGATCTCACCGATGAGATCG

TGAAAGATGTGAAACAGACCTACCTCGCCCGGGTGTTTAGCTACCCCGCC

GGCAATGTGGAGAGCACTGGTTCCGCTGGCGAGCCTTTATACGAGAACAG

CCCCGAATTTACCCCTTACCTCGAGACCAATTTAGGACAGCCCACCATCC

AAAGCTTTGAGCAAGTTGGCACAAAGGTGAATGTGACAGTGGAGGACGAG

CGGACTTTAGTGCGGCGGAACAACACCTTTCTCAGCCTCCGGGATGTGTT

CGGCAAAGATTTAATCTACACACTGTATTACTGGAAGTCCTCTTCCTCCG

-continued
GCAAGAAGACAGCTAAAACCAACACAAACGAGTTTTTAATCGACGTGGAT

AAAGGCGAAAACTACTGTTTCAGCGTGCAAGCTGTGATCCCCTCCCGGAC

CGTGAATAGGAAAAGCACCGATAGCCCCGTTGAGTGCATGGGCCAAGAAA

AGGGCGAGTTCCGGGAGAACTGGGTGAACGTCATCAGCGATTTAAAGAAG

ATCGAAGATTTAATTCAGTCCATGCATATCGACGCCACTTTATACACAGA

ATCCGACGTGCACCCCTCTTGTAAGGTGACCGCCATGAAATGTTTTTTAC

TGGAGCTGCAAGTTATCTCTTTAGAGAGCGGAGACGCTAGCATCCACGAC

ACCGTGGAGAATTTAATCATTTTAGCCAATAACTCTTTATCCAGCAACGG

CAACGTGACAGAGTCCGGCTGCAAGGAGTGCGAAGAGCTGGAGGAGAAGA

ACATCAAGGAGTTTCTGCAATCCTTTGTGCACATTGTCCAGATGTTCATC

AATACCTCC.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 203)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EHITCPPPMSVEHADIWVKSYSLYSRERYICNSGFKRKAGTSSLTECVLN

KATNVAHWTTPSLKCIR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 204)
GATTGTGATATTGAAGGTAAAGATGGCAAACAATATGAGAGTGTTCTAAT

GGTCAGCATCGATCAATTATTGGACAGCATGAAAGAAATTGGTAGCAATT

GCCTGAATAATGAATTTAACTTTTTTAAAAGACATATCTGTGATGCTAAT

AAGGAAGGTATGTTTTTATTCCGTGCTGCTCGCAAGTTGAGGCAATTTCT

TAAAATGAATAGCACTGGTGATTTTGATCTCCACTTATTAAAAGTTTCAG

AAGGCACAACAATACTGTTGAACTGCACTGGCCAGGTTAAAGGAAGAAAA

CCAGCTGCCCTGGGTGAAGCCCAACCAACAAAGAGTTTGGAAGAAAATAA

ATCTTTAAAGGAACAGAAAAAACTGAATGACTTGTGTTTCCTAAAGAGAC

TATTACAAGAGATAAAAACTTGTTGGAATAAAATTTTGATGGGCACTAAA

GAACACATCACGTGCCCTCCCCCCATGTCCGTGGAACACGCAGACATCTG

GGTCAAGAGCTACAGCTTGTACTCCAGGGAGCGGTACATTTGTAACTCTG

-continued

```
GTTTCAAGCGTAAAGCCGGCACGTCCAGCCTGACGGAGTGCGTGTTGAAC

AAGGCCACGAATGTCGCCCACTGGACAACCCCCAGTCTCAAATGCATTAG

A.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                          (SEQ ID NO: 250)
MKWVTFISLLFLFSSAYSDCDIEGKDGKQYESVLMVSIDQLLDSMKEIGS

NCLNNEFNFFKRHICDANKEGMFLFRAARKLRQFLKMNSTGDFDLHLLKV

SEGTTILLLNCTGQVKGRKPAALGEAQPTKSLEENKSLKEQKKLNDLCFLK

RLLQEIKTCWNKILMGTKEHITCPPPMSVEHADIWVKSYSLYSRERYICN

SGFKRKAGTSSLTECVLNKATNVAHWTTPSLKCIR.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                          (SEQ ID NO: 251)
ATGAAGTGGGTGACCTTCATCAGCCTGCTGTTCCTGTTCTCCAGCGCCTA

CTCCGATTGCGACATCGAGGGCAAGGACGGCAAGCAGTACGAGAGCGTGC

TGATGGTGTCCATCGACCAGCTGCTGGACAGCATGAAGGAGATCGGCTCC

AACTGCCTCAACAACGAGTTCAACTTCTTCAAGCGGCACATCTGCGACGC

CAACAAGGAGGGCATGTTCCTGTTCAGGGCCGCCAGGAAACTGCGGCAGT

TCCTGAAGATGAACTCCACCGGCGACTTCGACCTGCACCTGCTGAAGGTG

TCCGAGGGCACCACCATCCTGCTGAACTGCACCGGACAGGTGAAGGGCCG

GAAACCTGCTGCTCTGGGAGAGGCCCAACCCACCAAGAGCCTGGAGGAGA

ACAAGTCCCTGAAGGAGCAGAAGAAGCTGAACGACCTGTGCTTCCTGAAG

AGGCTGCTGCAGGAGATCAAGACCTGCTGGAACAAGATCCTGATGGGCAC

CAAGGAGCATATTACATGCCCCCCTCCCATGAGCGTGGAGCACGCCGACA

TCTGGGTGAAGAGCTATAGCCTCTACAGCCGGGAGAGGTATATCTGTAAC

AGCGGCTTCAAGAGGAAGGCCGGCACCAGCAGCCTCACCGAGTGCGTGCT

GAATAAGGCTACCAACGTGGCTCACTGGACAACACCCTCTTTAAAGTGCA

TCCGG.
```

Exemplary Multi-Chain Chimeric Polypeptides—Type I

In some embodiments of any of the multi-chain chimeric polypeptides described herein, the first target-binding domain and the second targeting-binding domain each independently bind specifically to TGF-β. In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, the first target-binding domain and the second target-binding domain each independently bind specifically to TGF-β. In some embodiments of these multi-chain chimeric polypeptides, the first target-binding domain and the second target-binding domain bind specifically to the same epitope. In some embodiments of these multi-chain chimeric polypeptides, the first target-binding domain and the second target-binding domain include the same amino acid sequence.

In some embodiments of these multi-chain chimeric polypeptides, the first target-binding domain and the second target-binding domain is a soluble TGF-β receptor (e.g., a soluble TGFβRII receptor, e.g., a soluble human TGFβRII). In some embodiments of these multi-chain chimeric polypeptides, the soluble human TGFRβRII includes a first sequence of soluble human TGFRβRII and a second sequence of soluble human TGFRβRII. In some embodiments of these multi-chain chimeric polypeptides, the soluble human TGFRβRII includes a linker disposed between the first sequence of soluble human TGFRβRII and the second sequence of soluble human TGFRβRII. In some examples of these multi-chain chimeric polypeptides, the linker includes the sequence GGGGSGGGGSGGGGS (SEQ ID NO: 102).

In some embodiments of these multi-chain chimeric polypeptides, the first sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 183)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the second sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 184)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the first sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 185)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGAT.

In some embodiments of these multi-chain chimeric polypeptides, the second sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 186)
ATTCCTCCCCACGTGCAGAAGAGCGTGAATAATGACATGATCGTGACCGA

TAACAATGGCGCCGTGAAATTTCCCCAGCTGTGCAAATTCTGCGATGTGA

GGTTTTCCACCTGCGACAACCAGAAGTCCTGTATGAGCAACTGCTCCATC

ACCTCCATCTGTGAGAAGCCTCAGGAGGTGTGCGTGGCTGTCTGGCGGAA

GAATGACGAGAATATCACCCTGGAAACCGTCTGCCACGATCCCAAGCTGC

CCTACCACGATTTCATCCTGGAAGACGCCGCCAGCCCTAAGTGCATCATG

AAAGAGAAAAAGAAGCCTGGCGAGACCTTTTTCATGTGCTCCTGCAGCAG

CGACGAATGCAACGACAATATCATCTTTAGCGAGGAATACAATACCAGCA

ACCCCGAC.

In some embodiments of these multi-chain chimeric polypeptides, the soluble TGF-β receptor includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 188)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD.

In some embodiments of these multi-chain chimeric polypeptides, the soluble TGF-β receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 187)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGAC.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 236)
IPPHVQKSVNNDMIVTDNNGAVKFPQLCKFCDVRFSTCDNQKSCMSNCSI
TSICEKPQEVCVAVWRKNDENITLETVCHDPKLPYHDFILEDAASPKCIM
KEKKKPGETFFMCSCSSDECNDNIIFSEEYNTSNPDGGGGSGGGGSGGGG
SIPPHVQKSVNNDMIVTDNNGAVKFPQLCKFCDVRFSTCDNQKSCMSNCS
ITSICEKPQEVCVAVWRKNDENITLETVCHDPKLPYHDFILEDAASPKCI
MKEKKKPGETFFMCSCSSDECNDNIIFSEEYNTSNPDSGTTNTVAAYNLT
WKSTNFKTILEWEPKPVNQVYTVQISTKSGDWKSKCFYTTDTECDLTDEI
VKDVKQTYLARVFSYPAGNVESTGSAGEPLYENSPEFTPYLETNLGQPTI
QSFEQVGTKVNVTVEDERTLVRRNNTFLSLRDVFGKDLIYTLYYWKSSSS
GKKTAKTNTNEFLIDVDKGENYCFSVQAVIPSRTVNRKSTDSPVECMGQE
KGEFRENWVNVISDLKKIEDLIQSMHIDATLYTESDVHPSCKVTAMKCFL
LELQVISLESGDASIHDTVENLIILANNSLSSNGNVTESGCKECEELEEK
NIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 237)
ATCCCCCCCCATGTGCAAAAGAGCGTGAACAACGATATGATCGTGACCGA
CAACAACGGCGCCGTGAAGTTTCCCCAGCTCTGCAAGTTCTGCGATGTCA
GGTTCAGCACCTGCGATAATCAGAAGTCCTGCATGTCCAACTGCAGCATC
ACCTCCATCTGCGAGAAGCCCCAAGAAGTGTGCGTGGCCGTGTGGCGGAA
AAATGACGAGAACATCACCCTGGAGACCGTGTGTCACGACCCCAAGCTCC
CTTATCACGACTTCATTCTGGAGGACGCTGCCTCCCCCAAATGCATCATG
AAGGAGAAGAAGAAGCCCGGAGAGACCTTCTTTATGTGTTCCTGTAGCAG
CGACGAGTGTAACGACAACATCATCTTCAGCGAAGAGTACAACACCAGCA
ACCCTGATGGAGGTGGCGGATCCGGAGGTGGAGGTTCTGGTGGAGGTGGG
AGTATTCCTCCCCACGTGCAGAAGAGCGTGAATAATGACATGATCGTGAC
CGATAACAATGGCGCCGTGAAATTTCCCCAGCTGTGCAAATTCTGCGATG
TGAGGTTTTCCACCTGCGACAACCAGAAGTCCTGTATGAGCAACTGCTCC
ATCACCTCCATCTGTGAGAAGCCTCAGGAGGTGTGCGTGGCTGTCTGGCG
GAAGAATGACGAGAATATCACCCTGGAAACCGTCTGCCACGATCCCAAGC
TGCCCTACCACGATTTCATCCTGGAAGACGCCGCCAGCCCTAAGTGCATC
ATGAAAGAGAAAAAGAAGCCTGGCGAGACCTTTTTCATGTGCTCCTGCAG

CAGCGACGAATGCAACGACAATATCATCTTTAGCGAGGAATACAATACCA
GCAACCCCGACAGCGGCACAACCAACACAGTCGCTGCCTATAACCTCACT
TGGAAGAGCACCAACTTCAAAACCATCCTCGAATGGGAACCCAAACCCGT
TAACCAAGTTTACACCGTGCAGATCAGCACCAAGTCCGGCGACTGGAAGT
CCAAATGTTTCTATACCACCGACACCGAGTGCGATCTCACCGATGAGATC
GTGAAAGATGTGAAACAGACCTACCTCGCCCGGGTGTTTAGCTACCCCGC
CGGCAATGTGGAGAGCACTGGTTCCGCTGGCGAGCCTTTATACGAGAACA
GCCCCGAATTTACCCCTTACCTCGAGACCAATTTAGGACAGCCCACCATC
CAAAGCTTTGAGCAAGTTGGCACAAAGGTGAATGTGACAGTGGAGGACGA
GCGGACTTTAGTGCGGCGGAACAACACCTTTCTCAGCCTCCGGGATGTGT
TCGGCAAAGATTTAATCTACACACTGTATTACTGGAAGTCCTCTTCCTCC
GGCAAGAAGACAGCTAAAACCAACACAAACGAGTTTTTAATCGACGTGGA
TAAAGGCGAAAACTACTGTTTCAGCGTGCAAGCTGTGATCCCCTCCCGGA
CCGTGAATAGGAAAAGCACCGATAGCCCCGTTGAGTGCATGGGCCAAGAA
AAGGGCGAGTTCCGGGAGAACTGGGTGAACGTCATCAGCGATTTAAAGAA
GATCGAAGATTTAATTCAGTCCATGCATATCGACGCCACTTTATACACAG
AATCCGACGTGCACCCCTCTTGTAAGGTGACCGCCATGAAATGTTTTTTA
CTGGAGCTGCAAGTTATCTCTTTAGAGAGCGGAGACGCTAGCATCCACGA
CACCGTGGAGAATTTAATCATTTTAGCCAATAACTCTTTATCCAGCAACG
GCAACGTGACAGAGTCCGGCTGCAAGGAGTGCGAAGAGCTGGAGGAGAAG
AACATCAAGGAGTTTCTGCAATCCTTTGTGCACATTGTCCAGATGTTCAT
CAATACCTCC.

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 238)
MKWVTFISLLFLFSSAYSIPPHVQKSVNNDMIVTDNNGAVKFPQLCKFCD
VRFSTCDNQKSCMSNCSITSICEKPQEVCVAVWRKNDENITLETVCHDPK
LPYHDFILEDAASPKCIMKEKKKPGETFFMCSCSSDECNDNIIFSEEYNT
SNPDGGGGSGGGGSGGGGSIPPHVQKSVNNDMIVTDNNGAVKFPQLCKFC
DVRFSTCDNQKSCMSNCSITSICEKPQEVCVAVWRKNDENITLETVCHDP
KLPYHDFILEDAASPKCIMKEKKKPGETFFMCSCSSDECNDNIIFSEEYN
TSNPDSGTTNTVAAYNLTWKSTNFKTILEWEPKPVNQVYTVQISTKSGDW
KSKCFYTTDTECDLTDEIVKDVKQTYLARVFSYPAGNVESTGSAGEPLYE
NSPEFTPYLETNLGQPTIQSFEQVGTKVNVTVEDERTLVRRNNTFLSLRD
VFGKDLIYTLYYWKSSSSGKKTAKTNTNEFLIDVDKGENYCFSVQAVIPS
RTVNRKSTDSPVECMGQEKGEFRENWVNVISDLKKIEDLIQSMHIDATLY
TESDVHPSCKVTAMKCFLLELQVISLESGDASIHDTVENLIILANNSLSS
NGNVTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 239)
ATGAAGTGGGTGACCTTCATCAGCCTGCTGTTCCTGTTCTCCAGCGCCTA

CTCCATCCCCCCCCATGTGCAAAAGAGCGTGAACAACGATATGATCGTGA

CCGACAACAACGGCGCCGTGAAGTTTCCCCAGCTCTGCAAGTTCTGCGAT

GTCAGGTTCAGCACCTGCGATAATCAGAAGTCCTGCATGTCCAACTGCAG

CATCACCTCCATCTGCGAGAAGCCCCAAGAAGTGTGCGTGGCCGTGTGGC

GGAAAAATGACGAGAACATCACCCTGGAGACCGTGTGTCACGACCCCAAG

CTCCCTTATCACGACTTCATTCTGGAGGACGCTGCCTCCCCCAAATGCAT

CATGAAGGAGAAGAAGAAGCCCGGAGAGACCTTCTTTATGTGTTCCTGTA

GCAGCGACGAGTGTAACGACAACATCATCTTCAGCGAAGAGTACAACACC

AGCAACCCTGATGGAGGTGGCGGATCCGGAGGTGGAGGTTCTGGTGGAGG

TGGGAGTATTCCTCCCCACGTGCAGAAGAGCGTGAATAATGACATGATCG

TGACCGATAACAATGGCGCCGTGAAATTTCCCCAGCTGTGCAAATTCTGC

GATGTGAGGTTTTCCACCTGCGACAACCAGAAGTCCTGTATGAGCAACTG

CTCCATCACCTCCATCTGTGAGAAGCCTCAGGAGGTGTGCGTGGCTGTCT

GGCGGAAGAATGACGAGAATATCACCCTGGAAACCGTCTGCCACGATCCC

AAGCTGCCCTACCACGATTTCATCCTGGAAGACGCCGCCAGCCCTAAGTG

CATCATGAAAGAGAAAAAGAAGCCTGGCGAGACCTTTTTCATGTGCTCCT

GCAGCAGCGACGAATGCAACGACAATATCATCTTTAGCGAGGAATACAAT

ACCAGCAACCCCGACAGCGGCACAACCAACACAGTCGCTGCCTATAACCT

CACTTGGAAGAGCACCAACTTCAAAACCATCCTCGAATGGGAACCCAAAC

CCGTTAACCAAGTTTACACCGTGCAGATCAGCACCAAGTCCGGCGACTGG

AAGTCCAATGTTTCTATACCACCGACACCGAGTGCGATCTCACCGATGA

GATCGTGAAAGATGTGAAACAGACCTACCTCGCCCGGGTGTTTAGCTACC

CCGCCGGCAATGTGGAGAGCACTGGTTCCGCTGGCGAGCCTTTATACGAG

AACAGCCCCGAATTTACCCCTTACCTCGAGACCAATTTAGGACAGCCCAC

CATCCAAAGCTTTGAGCAAGTTGGCACAAAGGTGAATGTGACAGTGGAGG

ACGAGCGGACTTTAGTGCGGCGGAACAACACCTTTCTCAGCCTCCGGGAT

GTGTTCGGCAAAGATTTAATCTACACACTGTATTACTGGAAGTCCTCTTC

CTCCGGCAAGAAGACAGCTAAAACCAACACAAACGAGTTTTTAATCGACG

TGGATAAAGGCGAAAACTACTGTTTCAGCGTGCAAGCTGTGATCCCCTCC

CGGACCGTGAATAGGAAAAGCACCGATAGCCCCGTTGAGTGCATGGGCCA

AGAAAAGGGCGAGTTCCGGGAGAACTGGGTGAACGTCATCAGCGATTTAA

AGAAGATCGAAGATTTAATTCAGTCCATGCATATCGACGCCACTTTATAC

ACAGAATCCGACGTGCACCCCTCTTGTAAGGTGACCGCCATGAAATGTTT

TTTACTGGAGCTGCAAGTTATCTCTTTAGAGAGCGGAGACGCTAGCATCC

-continued

ACGACACCGTGGAGAATTTAATCATTTTAGCCAATAACTCTTTATCCAGC

AACGGCAACGTGACAGAGTCCGGCTGCAAGGAGTGCGAAGAGCTGGAGGA

GAAGAACATCAAGGAGTTTCTGCAATCCTTTGTGCACATTGTCCAGATGT

TCATCAATACCTCC.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 193)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPDITCPPPMSVEHAD

IWVKSYSLYSRERYICNSGFKRKAGTSSLTECVLNKATNVAHWTTPSLKC

IR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 257)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

-continued

```
GCAACCCCGACATTACATGCCCCCCTCCCATGAGCGTGGAGCACGCCGAC

ATCTGGGTGAAGAGCTATAGCCTCTACAGCCGGGAGAGGTATATCTGTAA

CAGCGGCTTCAAGAGGAAGGCCGGCACCAGCAGCCTCACCGAGTGCGTGC

TGAATAAGGCTACCAACGTGGCTCACTGGACAACACCCTCTTTAAAGTGC

ATCCGG.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 195)
```
MKWVTFISLLFLFSSAYSIPPHVQKSVNNDMIVTDNNGAVKFPQLCKFCD

VRFSTCDNQKSCMSNCSITSICEKPQEVCVAVWRKNDENITLETVCHDPK

LPYHDFILEDAASPKCIMKEKKKPGETFFMCSCSSDECNDNIIFSEEYNT

SNPDGGGGSGGGGSGGGGSIPPHVQKSVNNDMIVTDNNGAVKFPQLCKFC

DVRFSTCDNQKSCMSNCSITSICEKPQEVCVAVWRKNDENITLETVCHDP

KLPYHDFILEDAASPKCIMKEKKKPGETFFMCSCSSDECNDNIIFSEEYN

TSNPDITCPPPMSVEHADIWVKSYSLYSRERYICNSGFKRKAGTSSLTEC

VLNKATNVAHWTTPSLKCIR.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 259)
```
ATGAAGTGGGTGACCTTCATCAGCCTGCTGTTCCTGTTCTCCAGCGCCTA

CTCCATCCCCCCCATGTGCAAAAGAGCGTGAACAACGATATGATCGTGA

CCGACAACAACGGCGCCGTGAAGTTTCCCCAGCTCTGCAAGTTCTGCGAT

GTCAGGTTCAGCACCTGCGATAATCAGAAGTCCTGCATGTCCAACTGCAG

CATCACCTCCATCTGCGAGAAGCCCCAAGAAGTGTGCGTGGCCGTGTGGC

GGAAAAATGACGAGAACATCACCCTGGAGACCGTGTGTCACGACCCCAAG

CTCCCTTATCACGACTTCATTCTGGAGGACGCTGCCTCCCCCAAATGCAT

CATGAAGGAGAAGAAGAAGCCCGGAGAGACCTTCTTTATGTGTTCCTGTA

GCAGCGACGAGTGTAACGACAACATCATCTTCAGCGAAGAGTACAACACC

AGCAACCCTGATGGAGGTGGCGGATCCGGAGGTGGAGGTTCTGGTGGAGG

TGGGAGTATTCCTCCCCACGTGCAGAAGAGCGTGAATAATGACATGATCG

TGACCGATAACAATGGCGCCGTGAAATTTCCCCAGCTGTGCAAATTCTGC

GATGTGAGGTTTTCCACCTGCGACAACCAGAAGTCCTGTATGAGCAACTG

CTCCATCACCTCCATCTGTGAGAAGCCTCAGGAGGTGTGCGTGGCTGTCT

GGCGGAAGAATGACGAGAATATCACCCTGGAAACCGTCTGCCACGATCCC

AAGCTGCCCTACCACGATTTCATCCTGGAAGACGCCGCCAGCCCTAAGTG

CATCATGAAAGAGAAAAAGAAGCCTGGCGAGACCTTTTTCATGTGCTCCT

GCAGCAGCGACGAATGCAACGACAATATCATCTTTAGCGAGGAATACAAT

ACCAGCAACCCCGACATTACATGCCCCCCTCCCATGAGCGTGGAGCACGC

CGACATCTGGGTGAAGAGCTATAGCCTCTACAGCCGGGAGAGGTATATCT

GTAACAGCGGCTTCAAGAGGAAGGCCGGCACCAGCAGCCTCACCGAGTGC

GTGCTGAATAAGGCTACCAACGTGGCTCACTGGACAACACCCTCTTTAAA

GTGCATCCGG.
```

Exemplary Multi-Chain Chimeric Polypeptides—Type J

In some embodiments of any of the multi-chain chimeric polypeptides described herein, the first target-binding domain and the second targeting-binding domain each independently bind specifically to a receptor of IL-7, a receptor of IL-21, or a receptor of CD137L. In some embodiments of these multi-chain chimeric polypeptides described herein, the second chimeric polypeptide further includes the additional target-binding domain. In some embodiments of these multi-chain chimeric polypeptides described herein, the additional target-binding domain binds specifically to a receptor for IL-21 (e.g., a soluble IL-21, e.g., a soluble human IL-21) or a receptor for CD137L (e.g., a soluble CD137L, e.g., a soluble human CD137L).

In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments, the second chimeric polypeptide further comprises one or more additional target-binding domains at the N-terminal end or the C-terminal end of the second chimeric polypeptide.

In some embodiments of these multi-chain chimeric polypeptides, the additional target-binding domain and the second domain of the pair of affinity domains directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the additional target-binding domain in the second chimeric polypeptide.

In some embodiments of these multi-chain chimeric polypeptides, the additional target-binding domain and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second target-binding domain and the additional target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments, the second chimeric polypeptide can include an additional target-binding domain.

In some embodiments of these multi-chain chimeric polypeptides, one or more of the first target-binding domain, the second target-binding domain and the additional target-binding domain is an agonistic antigen-binding domain. In some embodiments of these multi-chain chimeric polypeptides, the first target-binding domain, the second target-binding domain, and the additional target-binding domain are each agonistic antigen-binding domains. In some embodiments of these multi-chain chimeric polypeptides, the antigen-binding domain includes a scFv or single-domain antibody.

In some embodiments of these multi-chain chimeric polypeptides, the first target-binding domain binds specifically to a receptor for IL-7, and the second target-binding domain binds specifically to a receptor for IL-21 or a receptor for CD137L. In some embodiments, the additional target-binding domain binds specifically to a receptor for IL-21 or a receptor for CD137L.

In some embodiments of these multi-chain chimeric polypeptides, the first target-binding domain is a soluble IL-7 (e.g., a soluble human IL-7). In some embodiments of these multi-chain chimeric polypeptides, the soluble human IL-7 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                          (SEQ ID NO: 79)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EH.
```

In some embodiments of these multi-chain chimeric polypeptides, the soluble human IL-7 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                          (SEQ ID NO: 227)
GATTGCGACATCGAGGGCAAGGACGGCAAGCAGTACGAGAGCGTGCTGAT

GGTGTCCATCGACCAGCTGCTGGACAGCATGAAGGAGATCGGCTCCAACT

GCCTCAACAACGAGTTCAACTTCTTCAAGCGGCACATCTGCGACGCCAAC

AAGGAGGGCATGTTCCTGTTCAGGGCCGCCAGGAAACTGCGGCAGTTCCT

GAAGATGAACTCCACCGGCGACTTCGACCTGCACCTGCTGAAGGTGTCCG

AGGGCACCACCATCCTGCTGAACTGCACCGGACAGGTGAAGGGCCGGAAA

CCTGCTGCTCTGGGAGAGGCCCAACCCACCAAGAGCCTGGAGGAGAACAA

GTCCCTGAAGGAGCAGAAGAAGCTGAACGACCTGTGCTTCCTGAAGAGGC

TGCTGCAGGAGATCAAGACCTGCTGGAACAAGATCCTGATGGGCACCAAG

GAGCAT.
```

In some embodiments of these multi-chain chimeric polypeptides, the second target-binding domain or the additional target-binding domain binds specifically to a receptor for IL-21. In some embodiments of these multi-chain chimeric polypeptides, the second target-binding domain or the additional target-binding domain is a soluble IL-21 (e.g., a soluble human IL-21).

In some embodiments of these multi-chain chimeric polypeptides, a soluble human IL-21 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                          (SEQ ID NO: 83)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS.
```

In some embodiments of these multi-chain chimeric polypeptides, a soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                          (SEQ ID NO: 182)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCCAAGGAGTTCCTGGAGAGGTTCAAGTCCCTGCTGCAGAA

GATGATCCATCAGCACCTGTCCTCCAGGACCCACGGCTCCGAGGACTCC.
```

In some embodiments of these multi-chain chimeric polypeptides, the second target-binding domain binds specifically to a receptor for CD137L. In some embodiments of these multi-chain chimeric polypeptides, the second chimeric polypeptide further comprises an additional target-binding domain that binds specifically to a receptor for CD137L. In some embodiments of these multi-chain chimeric polypeptides, the second target-binding domain and/or the additional target-binding domain is a soluble CD137L (e.g., a soluble human CD137L).

In some embodiments of these multi-chain chimeric polypeptides, a soluble human CD137L includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 260)
REGPELSPDDPAGLLDLRQGMFAQLVAQNVLLIDGPLSWYSDPGLAGVSL

TGGLSYKEDTKELVVAKAGVYYVFFQLELRRVVAGEGSGSVSLALHLQPL

RSAAGAAALALTVDLPPASSEARNSAFGFQGRLLHLSAGQRLGVHLHTEA

RARHAWQLTQGATVLGLFRVTPEIPAGLPSPRSE.

In some embodiments of these multi-chain chimeric polypeptides, a soluble human CD137L is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 261)
CGCGAGGGTCCCGAGCTTTCGCCCGACGATCCCGCCGGCCTCTTGGACCT

GCGGCAGGGCATGTTTGCGCAGCTGGTGGCCCAAAATGTTCTGCTGATCG

ATGGGCCCCTGAGCTGGTACAGTGACCCAGGCCTGGCAGGCGTGTCCCTG

ACGGGGGGCCTGAGCTACAAAGAGGACACGAAGGAGCTGGTGGTGGCCAA

GGCTGGAGTCTACTATGTCTTCTTTCAACTAGAGCTGCGGCGCGTGGTGG

CCGGCGAGGGCTCAGGCTCCGTTTCACTTGCGCTGCACCTGCAGCCACTG

CGCTCTGCTGCTGGGGCCGCCGCCCTGGCTTTGACCGTGGACCTGCCACC

CGCCTCCTCCGAGGCTCGGAACTCGGCCTTCGGTTTCCAGGGCCGCTTGC

TGCACCTGAGTGCCGGCCAGCGCCTGGGCGTCCATCTTCACACTGAGGCC

AGGGCACGCCATGCCTGGCAGCTTACCCAGGGCGCCACAGTCTTGGGACT

CTTCCGGGTGACCCCCGAAATCCCAGCCGGACTCCCTTCACCGAGGTCGG

AA.

In some embodiments of these multi-chain chimeric polypeptides, a soluble human CD137L includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 262)
DPAGLLDLRQGMFAQLVAQNVLLIDGPLSWYSDPGLAGVSLTGGLSYKED

TKELVVAKAGVYYVFFQLELRRVVAGEGSGSVSLALHLQPLRSAAGAAAL

ALTVDLPPASSEARNSAFGFQGRLLHLSAGQRLGVHLHTEARARHAWQLT

QGATVLGLFRVTPEI.

In some embodiments of these multi-chain chimeric polypeptides, a soluble human CD137L is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 263)
GATCCCGCCGGCCTCTTGGACCTGCGGCAGGGCATGTTTGCGCAGCTGGT

GGCCCAAAATGTTCTGCTGATCGATGGGCCCCTGAGCTGGTACAGTGACC

CAGGCCTGGCAGGCGTGTCCCTGACGGGGGGCCTGAGCTACAAAGAGGAC

ACGAAGGAGCTGGTGGTGGCCAAGGCTGGAGTCTACTATGTCTTCTTTCA

ACTAGAGCTGCGGCGCGTGGTGGCCGGCGAGGGCTCAGGCTCCGTTTCAC

TTGCGCTGCACCTGCAGCCACTGCGCTCTGCTGCTGGGGCCGCCGCCCTG

GCTTTGACCGTGGACCTGCCACCCGCCTCCTCCGAGGCTCGGAACTCGGC

CTTCGGTTTCCAGGGCCGCTTGCTGCACCTGAGTGCCGGCCAGCGCCTGG

GCGTCCATCTTCACACTGAGGCCAGGGCACGCCATGCCTGGCAGCTTACC

CAGGGCGCCACAGTCTTGGGACTCTTCCGGGTGACCCCCGAAATC.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 207)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EHSGTTNTVAAYNLTWKSTNFKTILEWEPKPVNQVYTVQISTKSGDWKSK

CFYTTDTECDLTDEIVKDVKQTYLARVFSYPAGNVESTGSAGEPLYENSP

EFTPYLETNLGQPTIQSFEQVGTKVNVTVEDERTLVRRNNTFLSLRDVFG

KDLIYTLYYWKSSSSGKKTAKTNTNEFLIDVDKGENYCFSVQAVIPSRTV

NRKSTDSPVECMGQEKGEFRENWVNVISDLKKIEDLIQSMHIDATLYTES

DVHPSCKVTAMKCFLLELQVISLESGDASIHDTVENLIILANNSLSSNGN

VTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 208)
GATTGCGACATCGAGGGCAAGGACGGCAAGCAGTACGAGAGCGTGCTGAT

GGTGTCCATCGACCAGCTGCTGGACAGCATGAAGGAGATCGGCTCCAACT

GCCTCAACAACGAGTTCAACTTCTTCAAGCGGCACATCTGCGACGCCAAC

-continued
```
AAGGAGGGCATGTTCCTGTTCAGGGCCGCCAGGAAACTGCGGCAGTTCCT
GAAGATGAACTCCACCGGCGACTTCGACCTGCACCTGCTGAAGGTGTCCG
AGGGCACCACCATCCTGCTGAACTGCACCGGACAGGTGAAGGGCCGGAAA
CCTGCTGCTCTGGGAGAGGCCCAACCCACCAAGAGCCTGGAGGAGAACAA
GTCCCTGAAGGAGCAGAAGAAGCTGAACGACCTGTGCTTCCTGAAGAGGC
TGCTGCAGGAGATCAAGACCTGCTGGAACAAGATCCTGATGGGCACCAAG
GAGCATAGCGGCACAACCAACACAGTCGCTGCCTATAACCTCACTTGGAA
GAGCACCAACTTCAAAACCATCCTCGAATGGGAACCCAAACCCGTTAACC
AAGTTTACACCGTGCAGATCAGCACCAAGTCCGGCGACTGGAAGTCCAAA
TGTTTCTATACCACCGACACCGAGTGCGATCTCACCGATGAGATCGTGAA
AGATGTGAAACAGACCTACCTCGCCCGGGTGTTTAGCTACCCCGCCGGCA
ATGTGGAGAGCACTGGTTCCGCTGGCGAGCCTTTATACGAGAACAGCCCC
GAATTTACCCCTTACCTCGAGACCAATTTAGGACAGCCCACCATCCAAAG
CTTTGAGCAAGTTGGCACAAAGGTGAATGTGACAGTGGAGGACGAGCGGA
CTTTAGTGCGGCGGAACAACACCTTTCTCAGCCTCCGGGATGTGTTCGGC
AAAGATTTAATCTACACACTGTATTACTGGAAGTCCTCTTCCTCCGGCAA
GAAGACAGCTAAAACCAACACAAACGAGTTTTTAATCGACGTGGATAAAG
GCGAAAACTACTGTTTCAGCGTGCAAGCTGTGATCCCCTCCCGGACCGTG
AATAGGAAAAGCACCGATAGCCCCGTTGAGTGCATGGGCCAAGAAAAGGG
CGAGTTCCGGGAGAACTGGGTGAACGTCATCAGCGATTTAAAGAAGATCG
AAGATTTAATTCAGTCCATGCATATCGACGCCACTTTATACACAGAATCC
GACGTGCACCCCTCTTGTAAGGTGACCGCCATGAAATGTTTTTTACTGGA
GCTGCAAGTTATCTCTTTAGAGAGCGGAGACGCTAGCATCCACGACACCG
TGGAGAATTTAATCATTTTAGCCAATAACTCTTTATCCAGCAACGGCAAC
GTGACAGAGTCCGGCTGCAAGGAGTGCGAAGAGCTGGAGGAGAAGAACAT
CAAGGAGTTTCTGCAATCCTTTGTGCACATTGTCCAGATGTTCATCAATA
CCTCC.
```

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
(SEQ ID NO: 209)
MKWVTFISLLFLFSSAYSDCDIEGKDGKQYESVLMVSIDQLLDSMKEIGS
NCLNNEFNFFKRHICDANKEGMFLFRAARKLRQFLKMNSTGDFDLHLLKV
SEGTTILLNCTGQVKGRKPAALGEAQPTKSLEENKSLKEQKKLNDLCFLK
RLLQEIKTCWNKILMGTKEHSGTTNTVAAYNLTWKSTNFKTILEWEPKPV
NQVYTVQISTKSGDWKSKCFYTTDTECDLTDEIVKDVKQTYLARVFSYPA
GNVESTGSAGEPLYENSPEFTPYLETNLGQPTIQSFEQVGTKVNVTVEDE
RTLVRRNNTFLSLRDVFGKDLIYTLYYWKSSSSGKKTAKTNTNEFLIDVD
KGENYCFSVQAVIPSRTVNRKSTDSPVECMGQEKGEFRENWVNVISDLKK
IEDLIQSMHIDATLYTESDVHPSCKVTAMKCFLLELQVISLESGDASIHD
TVENLIILANNSLSSNGNVTESGCKECEELEEKNIKEFLQSFVHIVQMFI
NTS.
```

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
(SEQ ID NO: 210)
ATGAAGTGGGTGACCTTCATCAGCCTGCTGTTCCTGTTCTCCAGCGCCTA
CTCCGATTGCGACATCGAGGGCAAGGACGGCAAGCAGTACGAGAGCGTGC
TGATGGTGTCCATCGACCAGCTGCTGGACAGCATGAAGGAGATCGGCTCC
AACTGCCTCAACAACGAGTTCAACTTCTTCAAGCGGCACATCTGCGACGC
CAACAAGGAGGGCATGTTCCTGTTCAGGGCCGCCAGGAAACTGCGGCAGT
TCCTGAAGATGAACTCCACCGGCGACTTCGACCTGCACCTGCTGAAGGTG
TCCGAGGGCACCACCATCCTGCTGAACTGCACCGGACAGGTGAAGGGCCG
GAAACCTGCTGCTCTGGGAGAGGCCCAACCCACCAAGAGCCTGGAGGAGA
ACAAGTCCCTGAAGGAGCAGAAGAAGCTGAACGACCTGTGCTTCCTGAAG
AGGCTGCTGCAGGAGATCAAGACCTGCTGGAACAAGATCCTGATGGGCAC
CAAGGAGCATAGCGGCACAACCAACACAGTCGCTGCCTATAACCTCACTT
GGAAGAGCACCAACTTCAAAACCATCCTCGAATGGGAACCCAAACCCGTT
AACCAAGTTTACACCGTGCAGATCAGCACCAAGTCCGGCGACTGGAAGTC
CAAATGTTTCTATACCACCGACACCGAGTGCGATCTCACCGATGAGATCG
TGAAAGATGTGAAACAGACCTACCTCGCCCGGGTGTTTAGCTACCCCGCC
GGCAATGTGGAGAGCACTGGTTCCGCTGGCGAGCCTTTATACGAGAACAG
CCCCGAATTTACCCCTTACCTCGAGACCAATTTAGGACAGCCCACCATCC
AAAGCTTTGAGCAAGTTGGCACAAAGGTGAATGTGACAGTGGAGGACGAG
CGGACTTTAGTGCGGCGGAACAACACCTTTCTCAGCCTCCGGGATGTGTT
CGGCAAAGATTTAATCTACACACTGTATTACTGGAAGTCCTCTTCCTCCG
GCAAGAAGACAGCTAAAACCAACACAAACGAGTTTTTAATCGACGTGGAT
AAAGGCGAAAACTACTGTTTCAGCGTGCAAGCTGTGATCCCCTCCCGGAC
CGTGAATAGGAAAAGCACCGATAGCCCCGTTGAGTGCATGGGCCAAGAAA
AGGGCGAGTTCCGGGAGAACTGGGTGAACGTCATCAGCGATTTAAAGAAG
ATCGAAGATTTAATTCAGTCCATGCATATCGACGCCACTTTATACACAGA
ATCCGACGTGCACCCCTCTTGTAAGGTGACCGCCATGAAATGTTTTTTAC
TGGAGCTGCAAGTTATCTCTTTAGAGAGCGGAGACGCTAGCATCCACGAC
ACCGTGGAGAATTTAATCATTTTAGCCAATAACTCTTTATCCAGCAACGG
CAACGTGACAGAGTCCGGCTGCAAGGAGTGCGAAGAGCTGGAGGAGAAGA
ACATCAAGGAGTTTCTGCAATCCTTTGTGCACATTGTCCAGATGTTCATC
AATACCTCC.
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 268)
QGQDRHMIRMRQLIDIVDQLKNYVNDLVPEFLPAPEDVETNCEWSAFSCF

QKAQLKSANTGNNERIINVSIKKLKRKPPSTNAGRROKHRLTCPSCDSYE

KKPPKEFLERFKSLLQKMIHQHLSSRTHGSEDSITCPPPMSVEHADIWVK

SYSLYSRERYICNSGFKRKAGTSSLTECVLNKATNVAHWTTPSLKCIRGG

GGSGGGGSGGGGSREGPELSPDDPAGLLDLRQGMFAQLVAQNVLLIDGPL

SWYSDPGLAGVSLTGGLSYKEDTKELVVAKAGVYYVFFQLELRRVVAGEG

SGSVSLALHLQPLRSAAGAAALALTVDLPPASSEARNSAFGFQGRLLHLS

AGQRLGVHLHTEARARHAWQLTQGATVLGLFRVTPEIPAGLPSPRSE.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 269)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCCAAGGAGTTCCTGGAGAGGTTCAAGTCCCTGCTGCAGAA

GATGATCCATCAGCACCTGTCCTCCAGGACCCACGGCTCCGAGGACTCCA

TTACATGCCCCCCTCCCATGAGCGTGGAGCACGCCGACATCTGGGTGAAG

AGCTATAGCCTCTACAGCCGGGAGAGGTATATCTGTAACAGCGGCTTCAA

GAGGAAGGCCGGCACCAGCAGCCTCACCGAGTGCGTGCTGAATAAGGCTA

CCAACGTGGCTCACTGGACAACACCCTCTTTAAAGTGCATCCGGGGCGGT

GGAGGATCCGGAGGAGGTGGCTCCGGCGGCGGAGGATCTCGCGAGGGTCC

CGAGCTTTCGCCCGACGATCCCGCCGGCCTCTTGGACCTGCGGCAGGGCA

TGTTTGCGCAGCTGGTGGCCCAAAATGTTCTGCTGATCGATGGGCCCCTG

AGCTGGTACAGTGACCCAGGCCTGGCAGGCGTGTCCCTGACGGGGGCCT

GAGCTACAAAGAGGACACGAAGGAGCTGGTGGTGGCCAAGGCTGGAGTCT

ACTATGTCTTCTTTCAACTAGAGCTGCGGCGCGTGGTGGCCGGCGAGGGC

TCAGGCTCCGTTTCACTTGCGCTGCACCTGCAGCCACTGCGCTCTGCTGC

TGGGGCCGCCGCCCTGGCTTTGACCGTGGACCTGCCACCCGCCTCCTCCG

AGGCTCGGAACTCGGCCTTCGGTTTCCAGGGCCGCTTGCTGCACCTGAGT

GCCGGCCAGCGCCTGGGCGTCCATCTTCACACTGAGGCCAGGGCACGCCA

TGCCTGGCAGCTTACCCAGGGCGCCACAGTCTTGGGACTCTTCCGGGTGA

CCCCCGAAATCCCAGCCGGACTCCCTTCACCGAGGTCGGAA.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 270)
MKWVTFISLLFLFSSAYSQGQDRHMIRMRQLIDIVDQLKNYVNDLVPEFL

PAPEDVETNCEWSAFSCFQKAQLKSANTGNNERIINVSIKKLKRKPPSTN

AGRRQKHRLTCPSCDSYEKKPPKEFLERFKSLLQKMIHQHLSSRTHGSED

SITCPPPMSVEHADIWVKSYSLYSRERYICNSGFKRKAGTSSLTECVLNK

ATNVAHWTTPSLKCIRGGGGSGGGGSGGGGSREGPELSPDDPAGLLDLRQ

GMFAQLVAQNVLLIDGPLSWYSDPGLAGVSLTGGLSYKEDTKELVVAKAG

VYYVFFQLELRRVVAGEGSGSVSLALHLQPLRSAAGAAALALTVDLPPAS

SEARNSAFGFQGRLLHLSAGQRLGVHLHTEARARHAWQLTQGATVLGLFR

VTPEIPAGLPSPRSE.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 271)
ATGAAGTGGGTGACCTTCATCAGCCTGCTGTTCCTGTTCTCCAGCGCCTA

CTCCCAGGGCCAGGACAGGCACATGATCCGGATGAGGCAGCTCATCGACA

TCGTCGACCAGCTGAAGAACTACGTGAACGACCTGGTGCCCGAGTTTCTG

CCTGCCCCCGAGGACGTGGAGACCAACTGCGAGTGGTCCGCCTTCTCCTG

CTTTCAGAAGGCCCAGCTGAAGTCCGCCAACACCGGCAACAACGAGCGGA

TCATCAACGTGAGCATCAAGAAGCTGAAGCGGAAGCCTCCCTCCACAAAC

GCCGGCAGGAGGCAGAAGCACAGGCTGACCTGCCCCAGCTGTGACTCCTA

CGAGAAGAAGCCCCCCAAGGAGTTCCTGGAGAGGTTCAAGTCCCTGCTGC

AGAAGATGATCCATCAGCACCTGTCCTCCAGGACCCACGGCTCCGAGGAC

TCCATTACATGCCCCCCTCCCATGAGCGTGGAGCACGCCGACATCTGGGT

GAAGAGCTATAGCCTCTACAGCCGGGAGAGGTATATCTGTAACAGCGGCT

TCAAGAGGAAGGCCGGCACCAGCAGCCTCACCGAGTGCGTGCTGAATAAG

GCTACCAACGTGGCTCACTGGACAACACCCTCTTTAAAGTGCATCCGGGG

CGGTGGAGGATCCGGAGGAGGTGGCTCCGGCGGCGGAGGATCTCGCGAGG

GTCCCGAGCTTTCGCCCGACGATCCCGCCGGCCTCTTGGACCTGCGGCAG

GGCATGTTTGCGCAGCTGGTGGCCCAAAATGTTCTGCTGATCGATGGGCC

CCTGAGCTGGTACAGTGACCCAGGCCTGGCAGGCGTGTCCCTGACGGGGG

-continued

```
GCCTGAGCTACAAAGAGGACACGAAGGAGCTGGTGGTGGCCAAGGCTGGA

GTCTACTATGTCTTCTTTCAACTAGAGCTGCGGCGCGTGGTGGCCGGCGA

GGGCTCAGGCTCCGTTTCACTTGCGCTGCACCTGCAGCCACTGCGCTCTG

CTGCTGGGGCCGCCGCCCTGGCTTTGACCGTGGACCTGCCACCCGCCTCC

TCCGAGGCTCGGAACTCGGCCTTCGGTTTCCAGGGCCGCTTGCTGCACCT

GAGTGCCGGCCAGCGCCTGGGCGTCCATCTTCACACTGAGGCCAGGGCAC

GCCATGCCTGGCAGCTTACCCAGGGCGCCACAGTCTTGGGACTCTTCCGG

GTGACCCCCGAAATCCCAGCCGGACTCCCTTCACCGAGGTCGGAA.
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                     (SEQ ID NO: 272)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDSITCPPPMSVEHADIWVK

SYSLYSRERYICNSGFKRKAGTSSLTECVLNKATNVAHWTTPSLKCIRGG

GGSGGGGSGGGGSDPAGLLDLRQGMFAQLVAQNVLLIDGPLSWYSDPGLA

GVSLTGGLSYKEDTKELVVAKAGVYYVFFQLELRRVVAGEGSGSVSLALH

LQPLRSAAGAAALALTVDLPPASSEARNSAFGFQGRLLHLSAGQRLGVHL

HTEARARHAWQLTQGATVLGLFRVTPEI.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                     (SEQ ID NO: 273)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCAAGGAGTTCCTGGAGAGGTTCAAGTCCCTGCTGCAGAA

GATGATCCATCAGCACCTGTCCTCCAGGACCCACGGCTCCGAGGACTCCA

TTACATGCCCCCCTCCCATGAGCGTGGAGCACGCCGACATCTGGGTGAAG

AGCTATAGCCTCTACAGCCGGGAGAGGTATATCTGTAACAGCGGCTTCAA

GAGGAAGGCCGGCACCAGCAGCCTCACCGAGTGCGTGCTGAATAAGGCTA

CCAACGTGGCTCACTGGACAACACCCTCTTTAAAGTGCATCCGGGGCGGT
```

```
GGAGGATCCGGAGGAGGTGGCTCCGGCGGCGGAGGATCTGATCCCGCCGG

CCTCTTGGACCTGCGGCAGGGCATGTTTGCGCAGCTGGTGGCCCAAAATG

TTCTGCTGATCGATGGGCCCCTGAGCTGGTACAGTGACCCAGGCCTGGCA

GGCGTGTCCCTGACGGGGGGCCTGAGCTACAAAGAGGACACGAAGGAGCT

GGTGGTGGCCAAGGCTGGAGTCTACTATGTCTTCTTTCAACTAGAGCTGC

GGCGCGTGGTGGCCGGCGAGGGCTCAGGCTCCGTTTCACTTGCGCTGCAC

CTGCAGCCACTGCGCTCTGCTGCTGGGGCCGCCGCCCTGGCTTTGACCGT

GGACCTGCCACCCGCCTCCTCCGAGGCTCGGAACTCGGCCTTCGGTTTCC

AGGGCCGCTTGCTGCACCTGAGTGCCGGCCAGCGCCTGGGCGTCCATCTT

CACACTGAGGCCAGGGCACGCCATGCCTGGCAGCTTACCCAGGGCGCCAC

AGTCTTGGGACTCTTCCGGGTGACCCCCGAAATC.
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                     (SEQ ID NO: 274)
MKWVTFISLLFLFSSAYSQGQDRHMIRMRQLIDIVDQLKNYVNDLVPEFL

PAPEDVETNCEWSAFSCFQKAQLKSANTGNNERIINVSIKKLKRKPPSTN

AGRRQKHRLTCPSCDSYEKKPPKEFLERFKSLLQKMIHQHLSSRTHGSED

SITCPPPMSVEHADIWVKSYSLYSRERYICNSGFKRKAGTSSLTECVLNK

ATNVAHWTTPSLKCIRGGGGSGGGGSGGGGSDPAGLLDLRQGMFAQLVAQ

NVLLIDGPLSWYSDPGLAGVSLTGGLSYKEDTKELVVAKAGVYYVFFQLE

LRRVVAGEGSGSVSLALHLQPLRSAAGAAALALTVDLPPASSEARNSAFG

FQGRLLHLSAGQRLGVHLHTEARARHAWQLTQGATVLGLFRVTPEI.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                     (SEQ ID NO: 275)
ATGAAGTGGGTGACCTTCATCAGCCTGCTGTTCCTGTTCTCCAGCGCCTA

CTCCCAGGGCCAGGACAGGCACATGATCCGGATGAGGCAGCTCATCGACA

TCGTCGACCAGCTGAAGAACTACGTGAACGACCTGGTGCCCGAGTTTCTG

CCTGCCCCCGAGGACGTGGAGACCAACTGCGAGTGGTCCGCCTTCTCCTG

CTTTCAGAAGGCCCAGCTGAAGTCCGCCAACACCGGCAACAACGAGCGGA

TCATCAACGTGAGCATCAAGAAGCTGAAGCGGAAGCCTCCCTCCACAAAC

GCCGGCAGGAGGCAGAAGCACAGGCTGACCTGCCCCAGCTGTGACTCCTA

CGAGAAGAAGCCCCCAAGGAGTTCCTGGAGAGGTTCAAGTCCCTGCTGC

AGAAGATGATCCATCAGCACCTGTCCTCCAGGACCCACGGCTCCGAGGAC

TCCATTACATGCCCCCCTCCCATGAGCGTGGAGCACGCCGACATCTGGGT
```

-continued

```
GAAGAGCTATAGCCTCTACAGCCGGGAGAGGTATATCTGTAACAGCGGCT

TCAAGAGGAAGGCCGGCACCAGCAGCCTCACCGAGTGCGTGCTGAATAAG

GCTACCAACGTGGCTCACTGGACAACACCCTCTTTAAAGTGCATCCGGGG

CGGTGGAGGATCCGGAGGAGGTGGCTCCGGCGGCGGAGGATCTGATCCCG

CCGGCCTCTTGGACCTGCGGCAGGGCATGTTTGCGCAGCTGGTGGCCCAA

AATGTTCTGCTGATCGATGGGCCCCTGAGCTGGTACAGTGACCCAGGCCT

GGCAGGCGTGTCCCTGACGGGGGGCCTGAGCTACAAAGAGGACACGAAGG

AGCTGGTGGTGGCCAAGGCTGGAGTCTACTATGTCTTCTTTCAACTAGAG

CTGCGGCGCGTGGTGGCCGGCGAGGGCTCAGGCTCCGTTTCACTTGCGCT

GCACCTGCAGCCACTGCGCTCTGCTGCTGGGGCCGCCGCCCTGGCTTTGA

CCGTGGACCTGCCACCCGCCTCCTCCGAGGCTCGGAACTCGGCCTTCGGT

TTCCAGGGCCGCTTGCTGCACCTGAGTGCCGGCCAGCGCCTGGGCGTCCA

TCTTCACACTGAGGCCAGGGCACGCCATGCCTGGCAGCTTACCCAGGGCG

CCACAGTCTTGGGACTCTTCCGGGTGACCCCCGAAATC.
```

Exemplary Multi-Chain Chimeric Polypeptides—Type K

In some embodiments of any of the multi-chain chimeric polypeptides described herein, the first target-binding domain and the second targeting-binding domain each independently bind specifically to a receptor of IL-7 or TGF-β. In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, the first target-binding domain binds specifically to a receptor for IL-7, and the second target-binding domain binds specifically to TGF-β. In some embodiments of these multi-chain chimeric polypeptides, the first target-binding domain binds specifically to TGF-β, and the second target-binding domain binds specifically to a receptor for IL-7.

In some embodiments of these multi-chain chimeric polypeptides, the first target-binding domain includes a soluble IL-7 protein (e.g., a soluble human IL-7 protein). In some embodiments of these multi-chain chimeric polypeptides, the soluble human IL-7 protein includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 79)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EH.

In some embodiments of these multi-chain chimeric polypeptides, the soluble human IL-7 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                         (SEQ ID NO: 227)
GATTGCGACATCGAGGGCAAGGACGGCAAGCAGTACGAGAGCGTGCTGAT

GGTGTCCATCGACCAGCTGCTGGACAGCATGAAGGAGATCGGCTCCAACT

GCCTCAACAACGAGTTCAACTTCTTCAAGCGGCACATCTGCGACGCCAAC

AAGGAGGGCATGTTCCTGTTCAGGGCCGCCAGGAAACTGCGGCAGTTCCT

GAAGATGAACTCCACCGGCGACTTCGACCTGCACCTGCTGAAGGTGTCCG

AGGGCACCACCATCCTGCTGAACTGCACCGGACAGGTGAAGGGCCGGAAA

CCTGCTGCTCTGGGAGAGGCCCAACCCACCAAGAGCCTGGAGGAGAACAA

GTCCCTGAAGGAGCAGAAGAAGCTGAACGACCTGTGCTTCCTGAAGAGGC

TGCTGCAGGAGATCAAGACCTGCTGGAACAAGATCCTGATGGGCACCAAG

GAGCAT.
```

In some embodiments of these multi-chain chimeric polypeptides, the second target-binding domain comprises a target-binding domain that binds specifically to TGF-β. In some embodiments of these multi-chain chimeric polypeptides, the second target-binding domain is a soluble TGF-β receptor (e.g., a soluble TGFβRII receptor, e.g., a soluble human TGFβRII receptor). In some embodiments of these multi-chain chimeric polypeptides, the soluble human TGFRβRII includes a first sequence of soluble human TGFRβRII and a second sequence of soluble human TGFRβRII. In some embodiments of these multi-chain chimeric polypeptides, the soluble human TGFRβRII includes a linker disposed between the first sequence of soluble human TGFRβRII and the second sequence of soluble human TGFRβRII. In some examples of these multi-chain chimeric polypeptides, the linker includes the sequence GGGGSGGGGSGGGGS (SEQ ID NO: 102).

In some embodiments of these multi-chain chimeric polypeptides, the first sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 183)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the second sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 184)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the first sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 185)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGAT.

In some embodiments of these multi-chain chimeric polypeptides, the second sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100%

(SEQ ID NO: 186)
ATTCCTCCCCACGTGCAGAAGAGCGTGAATAATGACATGATCGTGACCGA

TAACAATGGCGCCGTGAAATTTCCCCAGCTGTGCAAATTCTGCGATGTGA

GGTTTTCCACCTGCGACAACCAGAAGTCCTGTATGAGCAACTGCTCCATC

ACCTCCATCTGTGAGAAGCCTCAGGAGGTGTGCGTGGCTGTCTGGCGGAA

GAATGACGAGAATATCACCCTGGAAACCGTCTGCCACGATCCCAAGCTGC

CCTACCACGATTTCATCCTGGAAGACGCCGCCAGCCCTAAGTGCATCATG

AAAGAGAAAAAGAAGCCTGGCGAGACCTTTTTCATGTGCTCCTGCAGCAG

CGACGAATGCAACGACAATATCATCTTTAGCGAGGAATACAATACCAGCA

ACCCCGAC.

In some embodiments of these multi-chain chimeric polypeptides, the soluble TGF-β receptor includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 188)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD.

In some embodiments of these multi-chain chimeric polypeptides, the soluble TGF-β receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 187)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

```
ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGAC.
```

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                    (SEQ ID NO: 207)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EHSGTTNTVAAYNLTWKSTNFKTILEWEPKPVNQVYTVQISTKSGDWKSK

CFYTTDTECDLTDEIVKDVKQTYLARVFSYPAGNVESTGSAGEPLYENSP

EFTPYLETNLGQPTIQSFEQVGTKVNVTVEDERTLVRRNNTFLSLRDVFG

KDLIYTLYYWKSSSSGKKTAKTNTNEFLIDVDKGENYCFSVQAVIPSRTV

NRKSTDSPVECMGQEKGEFRENWVNVISDLKKIEDLIQSMHIDATLYTES

DVHPSCKVTAMKCFLLELQVISLESGDASIHDTVENLIILANNSLSSNGN

VTESGCKECEELEEKNIKEFLQSFVHIVQMFINTS.
```

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                    (SEQ ID NO: 208)
GATTGCGACATCGAGGGCAAGGACGGCAAGCAGTACGAGAGCGTGCTGAT

GGTGTCCATCGACCAGCTGCTGGACAGCATGAAGGAGATCGGCTCCAACT

GCCTCAACAACGAGTTCAACTTCTTCAAGCGGCACATCTGCGACGCCAAC

AAGGAGGGCATGTTCCTGTTCAGGGCCGCCAGGAAACTGCGGCAGTTCCT

GAAGATGAACTCCACCGGCGACTTCGACCTGCACCTGCTGAAGGTGTCCG

AGGGCACCACCATCCTGCTGAACTGCACCGGACAGGTGAAGGGCCGGAAA

CCTGCTGCTCTGGGAGAGGCCCAACCCACCAAGAGCCTGGAGGAGAACAA

GTCCCTGAAGGAGCAGAAGAAGCTGAACGACCTGTGCTTCCTGAAGAGGC

TGCTGCAGGAGATCAAGACCTGCTGGAACAAGATCCTGATGGGCACCAAG

GAGCATAGCGGCACAACCAACACAGTCGCTGCCTATAACCTCACTTGGAA

GAGCACCAACTTCAAAACCATCCTCGAATGGGAACCCAAACCCGTTAACC

AAGTTTACACCGTGCAGATCAGCACCAAGTCCGGCGACTGGAAGTCCAAA

TGTTTCTATACCACCGACACCGAGTGCGATCTCACCGATGAGATCGTGAA
```

```
AGATGTGAAACAGACCTACCTCGCCCGGGTGTTTAGCTACCCCGCCGGCA

ATGTGGAGAGCACTGGTTCCGCTGGCGAGCCTTTATACGAGAACAGCCCC

GAATTTACCCCTTACCTCGAGACCAATTTAGGACAGCCCACCATCCAAAG

CTTTGAGCAAGTTGGCACAAAGGTGAATGTGACAGTGGAGGACGAGCGGA

CTTTAGTGCGGCGGAACAACACCTTTCTCAGCCTCCGGGATGTGTTCGGC

AAAGATTTAATCTACACACTGTATTACTGGAAGTCCTCTTCCTCCGGCAA

GAAGACAGCTAAAACCAACACAAACGAGTTTTTAATCGACGTGGATAAAG

GCGAAAACTACTGTTTCAGCGTGCAAGCTGTGATCCCCTCCCGGACCGTG

AATAGGAAAAGCACCGATAGCCCCGTTGAGTGCATGGGCCAAGAAAAGGG

CGAGTTCCGGGAGAACTGGGTGAACGTCATCAGCGATTTAAAGAAGATCG

AAGATTTAATTCAGTCCATGCATATCGACGCCACTTTATACACAGAATCC

GACGTGCACCCCTCTTGTAAGGTGACCGCCATGAAATGTTTTTTACTGGA

GCTGCAAGTTATCTCTTTAGAGAGCGGAGACGCTAGCATCCACGACACCG

TGGAGAATTTAATCATTTTAGCCAATAACTCTTTATCCAGCAACGGCAAC

GTGACAGAGTCCGGCTGCAAGGAGTGCGAAGAGCTGGAGGAGAAGAACAT

CAAGGAGTTTCTGCAATCCTTTGTGCACATTGTCCAGATGTTCATCAATA

CCTCC.
```

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                    (SEQ ID NO: 209)
MKWVTFISLLFLFSSAYSDCDIEGKDGKQYESVLMVSIDQLLDSMKEIGS

NCLNNEFNFFKRHICDANKEGMFLFRAARKLRQFLKMNSTGDFDLHLLKV

SEGTTILLNCTGQVKGRKPAALGEAQPTKSLEENKSLKEQKKLNDLCFLK

RLLQEIKTCWNKILMGTKEHSGTTNTVAAYNLTWKSTNFKTILEWEPKPV

NQVYTVQISTKSGDWKSKCFYTTDTECDLTDEIVKDVKQTYLARVFSYPA

GNVESTGSAGEPLYENSPEFTPYLETNLGQPTIQSFEQVGTKVNVTVEDE

RTLVRRNNTFLSLRDVFGKDLIYTLYYWKSSSSGKKTAKTNTNEFLIDVD

KGENYCFSVQAVIPSRTVNRKSTDSPVECMGQEKGEFRENWVNVISDLKK

IEDLIQSMHIDATLYTESDVHPSCKVTAMKCFLLELQVISLESGDASIHD

TVENLIILANNSLSSNGNVTESGCKECEELEEKNIKEFLQSFVHIVQMFI

NTS.
```

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 210)
ATGAAGTGGGTGACCTTCATCAGCCTGCTGTTCCTGTTCTCCAGCGCCTA

CTCCGATTGCGACATCGAGGGCAAGGACGGCAAGCAGTACGAGAGCGTGC

TGATGGTGTCCATCGACCAGCTGCTGGACAGCATGAAGGAGATCGGCTCC

AACTGCCTCAACAACGAGTTCAACTTCTTCAAGCGGCACATCTGCGACGC

CAACAAGGAGGGCATGTTCCTGTTCAGGGCCGCCAGGAAACTGCGGCAGT

TCCTGAAGATGAACTCCACCGGCGACTTCGACCTGCACCTGCTGAAGGTG

TCCGAGGGCACCACCATCCTGCTGAACTGCACCGGACAGGTGAAGGGCCG

GAAACCTGCTGCTCTGGGAGAGGCCCAACCCACCAAGAGCCTGGAGGAGA

ACAAGTCCCTGAAGGAGCAGAAGAAGCTGAACGACCTGTGCTTCCTGAAG

AGGCTGCTGCAGGAGATCAAGACCTGCTGGAACAAGATCCTGATGGGCAC

CAAGGAGCATAGCGGCACAACCAACACAGTCGCTGCCTATAACCTCACTT

GGAAGAGCACCAACTTCAAAACCATCCTCGAATGGGAACCCAAACCCGTT

AACCAAGTTTACACCGTGCAGATCAGCACCAAGTCCGGCGACTGGAAGTC

CAAATGTTTCTATACCACCGACACCGAGTGCGATCTCACCGATGAGATCG

TGAAAGATGTGAAACAGACCTACCTCGCCCGGGTGTTTAGCTACCCCGCC

GGCAATGTGGAGAGCACTGGTTCCGCTGGCGAGCCTTTATACGAGAACAG

CCCCGAATTTACCCCTTACCTCGAGACCAATTTAGGACAGCCCACCATCC

AAAGCTTTGAGCAAGTTGGCACAAAGGTGAATGTGACAGTGGAGGACGAG

CGGACTTTAGTGCGGCGGAACAACACCTTTCTCAGCCTCCGGGATGTGTT

CGGCAAAGATTTAATCTACACACTGTATTACTGGAAGTCCTCTTCCTCCG

GCAAGAAGACAGCTAAAACCAACACAAACGAGTTTTTAATCGACGTGGAT

AAAGGCGAAAACTACTGTTTCAGCGTGCAAGCTGTGATCCCCTCCCGGAC

CGTGAATAGGAAAAGCACCGATAGCCCCGTTGAGTGCATGGGCCAAGAAA

AGGGCGAGTTCCGGGAGAACTGGGTGAACGTCATCAGCGATTTAAAGAAG

ATCGAAGATTTAATTCAGTCCATGCATATCGACGCCACTTTATACACAGA

ATCCGACGTGCACCCCTCTTGTAAGGTGACCGCCATGAAATGTTTTTTAC

TGGAGCTGCAAGTTATCTCTTTAGAGAGCGGAGACGCTAGCATCCACGAC

ACCGTGGAGAATTTAATCATTTTAGCCAATAACTCTTTATCCAGCAACGG

CAACGTGACAGAGTCCGGCTGCAAGGAGTGCGAAGAGCTGGAGGAGAAGA

ACATCAAGGAGTTTCTGCAATCCTTTGTGCACATTGTCCAGATGTTCATC

AATACCTCC.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 193)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPDITCPPPMSVEHAD

IWVKSYSLYSRERYICNSGFKRKAGTSSLTECVLNKATNVAHWTTPSLKC

IR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 257)
CAACGGCGCCGTGAAGTTTCCCCAGCTCTGCAAGTTCTGCGATGTCAGGT

TCAATCCCCCCCCATGTGCAAAAGAGCGTGAACAACGATATGATCGTGAC

CGACAAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAATTCTGGAGGACGCTGCCTCCCCCAAATGCATCATGAAG

GAGAAGAAGAAGCACATCACCCTGGAGACCGTGTGTCACGACCCCAAGCT

CCCTTATCACGACTTCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAAGAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGACATTACATGCCCCCCTCCCATGAGCGTGGAGCACGCCGAC

ATCTGGGTGAAGAGCTATAGCCTCTACAGCCGGGAGAGGTATATCTGTAA

CAGCGGCTTCAAGAGGAAGGCCGGCACCAGCAGCCTCACCGAGTGCGTGC

TGAATAAGGCTACCAACGTGGCTCACTGGACAACACCCTCTTTAAAGTGC

ATCCGG.

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 195)
MKWVTFISLLFLFSSAYSIPPHVQKSVNNDMIVTDNNGAVKFPQLCKFCD

VRFSTCDNQKSCMSNCSITSICEKPQEVCVAVWRKNDENITLETVCHDPK

-continued

LPYHDFILEDAASPKCIMKEKKKPGETFFMCSCSSDECNDNIIFSEEYNT

SNPDGGGGSGGGGSGGGGSIPPHVOKSVNNDMIVTDNNGAVKFPQLCKFC

DVRFSTCDNQKSCMSNCSITSICEKPQEVCVAVWRKNDENITLETVCHDP

KLPYHDFILEDAASPKCIMKEKKKPGETFFMCSCSSDECNDNIIFSEEYN

TSNPDITCPPPMSVEHADIWVKSYSLYSRERYICNSGFKRKAGTSSLTEC

VLNKATNVAHWTTPSLKCIR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 259)
ATGAAGTGGGTGACCTTCATCAGCCTGCTGTTCCTGTTCTCCAGCGCCTA

CTCCATCCCCCCCCATGTGCAAAAGAGCGTGAACAACGATATGATCGTGA

CCGACAACAACGGCGCCGTGAAGTTTCCCCAGCTCTGCAAGTTCTGCGAT

GTCAGGTTCAGCACCTGCGATAATCAGAAGTCCTGCATGTCCAACTGCAG

CATCACCTCCATCTGCGAGAAGCCCCAAGAAGTGTGCGTGGCCGTGTGGC

GGAAAAATGACGAGAACATCACCCTGGAGACCGTGTGTCACGACCCCAAG

CTCCCTTATCACGACTTCATTCTGGAGGACGCTGCCTCCCCCAAATGCAT

CATGAAGGAGAAGAAGAAGCCCGGAGAGACCTTCTTTATGTGTTCCTGTA

GCAGCGACGAGTGTAACGACAACATCATCTTCAGCGAAGAGTACAACACC

AGCAACCCTGATGGAGGTGGCGGATCCGGAGGTGGAGGTTCTGGTGGAGG

TGGGAGTATTCCTCCCCACGTGCAGAAGAGCGTGAATAATGACATGATCG

TGACCGATAACAATGGCGCCGTGAAATTTCCCCAGCTGTGCAAATTCTGC

GATGTGAGGTTTTCCACCTGCGACAACCAGAAGTCCTGTATGAGCAACTG

CTCCATCACCTCCATCTGTGAGAAGCCTCAGGAGGTGTGCGTGGCTGTCT

GGCGGAAGAATGACGAGAATATCACCCTGGAAACCGTCTGCCACGATCCC

AAGCTGCCCTACCACGATTTCATCCTGGAAGACGCCGCCAGCCCTAAGTG

CATCATGAAAGAGAAAAAGAAGCCTGGCGAGACCTTTTTCATGTGCTCCT

GCAGCAGCGACGAATGCAACGACAATATCATCTTTAGCGAGGAATACAAT

ACCAGCAACCCCGACATTACATGCCCCCCTCCCATGAGCGTGGAGCACGC

CGACATCTGGGTGAAGAGCTATAGCCTCTACAGCCGGGAGAGGTATATCT

GTAACAGCGGCTTCAAGAGGAAGGCCGGCACCAGCAGCCTCACCGAGTGC

GTGCTGAATAAGGCTACCAACGTGGCTCACTGGACAACACCCTCTTTAAA

GTGCATCCGG.

Exemplary Multi-Chain Chimeric Polypeptides—Type L

In some embodiments of any of the multi-chain chimeric polypeptides described herein, the first target-binding domain and the second targeting-binding domain each independently bind specifically to TGF-β, a receptor of IL-21, or a receptor of CD137L. In some embodiments of these multi-chain chimeric polypeptides described herein, the second chimeric polypeptide further includes the additional target-binding domain. In some embodiments of these multi-chain chimeric polypeptides described herein, the additional target-binding domain binds specifically to a receptor for IL-21 (e.g., a soluble IL-21, e.g., a soluble human IL-21) or a receptor for CD137L (e.g., a soluble CD137L, e.g., a soluble human CD137L).

In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments, the second chimeric polypeptide further comprises one or more additional target-binding domains at the N-terminal end or the C-terminal end of the second chimeric polypeptide.

In some embodiments of these multi-chain chimeric polypeptides, the additional target-binding domain and the second domain of the pair of affinity domains directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the additional target-binding domain in the second chimeric polypeptide.

In some embodiments of these multi-chain chimeric polypeptides, the additional target-binding domain and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second target-binding domain and the additional target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, one or more of the first target-binding domain, the second target-binding domain and the additional target-binding domain is an agonistic antigen-binding domain. In some embodiments of these multi-chain chimeric polypeptides, the first target-binding domain, the second target-binding domain, and the additional target-binding domain are each agonistic antigen-binding domains. In some embodiments of these multi-chain chimeric polypeptides, the antigen-binding domain includes a scFv or single-domain antibody.

In some embodiments of these multi-chain chimeric polypeptides, the first target-binding domain binds specifically to TGF-β and the second target-binding domain binds specifically to a receptor for IL-21 or a receptor for CD137L.

In some embodiments of these multi-chain chimeric polypeptides, the first target-binding domain is a soluble TGF-β receptor (e.g., a soluble TGFβRII receptor, e.g., a soluble human TGFβRII receptor). In some embodiments of these multi-chain chimeric polypeptides, the soluble human TGFRβRII includes a first sequence of soluble human TGFRβRII and a second sequence of soluble human TGFRβRII. In some embodiments of these multi-chain chimeric polypeptides, the soluble human TGFRβRII includes a linker disposed between the first sequence of soluble human TGFRβRII and the second sequence of soluble human TGFRβRII. In some examples of these multi-chain chimeric polypeptides, the linker includes the sequence GGGGSGGGGSGGGGS (SEQ ID NO: 102).

In some embodiments of these multi-chain chimeric polypeptides, the first sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 183)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the second sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 184)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the first sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 185)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGAT

In some embodiments of these multi-chain chimeric polypeptides, the second sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 186)
ATTCCTCCCCACGTGCAGAAGAGCGTGAATAATGACATGATCGTGACCGA

TAACAATGGCGCCGTGAAATTTCCCCAGCTGTGCAAATTCTGCGATGTGA

GGTTTTCCACCTGCGACAACCAGAAGTCCTGTATGAGCAACTGCTCCATC

ACCTCCATCTGTGAGAAGCCTCAGGAGGTGTGCGTGGCTGTCTGGCGGAA

GAATGACGAGAATATCACCCTGGAAACCGTCTGCCACGATCCCAAGCTGC

CCTACCACGATTTCATCCTGGAAGACGCCGCCAGCCCTAAGTGCATCATG

AAAGAGAAAAAGAAGCCTGGCGAGACCTTTTTCATGTGCTCCTGCAGCAG

CGACGAATGCAACGACAATATCATCTTTAGCGAGGAATACAATACCAGCA

ACCCCGAC.

In some embodiments of these multi-chain chimeric polypeptides, the soluble TGF-β receptor includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 188)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD.

In some embodiments of these multi-chain chimeric polypeptides, the soluble TGF-β receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 187)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGAC.

In some embodiments of these multi-chain chimeric polypeptides, the second target-binding domain or the additional target-binding domain binds specifically to a receptor for IL-21. In some embodiments of these multi-chain chimeric polypeptides, the second target-binding domain or the additional target-binding domain includes a soluble IL-21 (e.g., a soluble human IL-21).

In some embodiments of these multi-chain chimeric polypeptides, a soluble human IL-21 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 83)
QGQDRHMIRMRQLIDIVDQLKNYVNDLVPEFLPAPEDVETNCEWSAFSCF

QKAQLKSANTGNNERIINVSIKKLRKPPSTNAGRRQKHRLTCPSCDSYE

KKPPKEFLERFKSLLQKMIHQHLSSRTHGSEDS.

In some embodiments of these multi-chain chimeric polypeptides, the soluble human IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 182)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCCAAGGAGTTCCTGGAGAGGTTCAAGTCCCTGCTGCAGAA

GATGATCCATCAGCACCTGTCCTCCAGGACCCACGGCTCCGAGGACTCC.

In some embodiments of these multi-chain chimeric polypeptides, the second target-binding domain or the additional target-binding domain binds specifically to a receptor for CD137L. In some embodiments of these multi-chain chimeric polypeptides, the second target-binding domain and/or the additional target-binding domain includes a soluble CD137L (e.g., a soluble human CD137L).

In some embodiments of these multi-chain chimeric polypeptides, a soluble CD137L includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 260)
REGPELSPDDPAGLLDLRQGMFAQLVAQNVLLIDGPLSWYSDPGLAGVSL

TGGLSYKEDTKELVVAKAGVYYVFFQLELRRVVAGEGSGSVSLALHLQPL

RSAAGAAALALTVDLPPASSEARNSAFGFQGRLLHLSAGQRLGVHLHTEA

RARHAWQLTQGATVLGLFRVTPEIPAGLPSPRSE.

In some embodiments of these multi-chain chimeric polypeptides, a soluble CD137L is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 261)
CGCGAGGGTCCCGAGCTTTCGCCCGACGATCCCGCCGGCCTCTTGGACCT

GCGGCAGGGCATGTTTGCGCAGCTGGTGGCCCAAAATGTTCTGCTGATCG

ATGGGCCCCTGAGCTGGTACAGTGACCCAGGCCTGGCAGGCGTGTCCCTG

ACGGGGGGCCTGAGCTACAAAGAGGACACGAAGGAGCTGGTGGTGGCCAA

GGCTGGAGTCTACTATGTCTTCTTTCAACTAGAGCTGCGGCGCGTGGTGG

CCGGCGAGGGCTCAGGCTCCGTTTCACTTGCGCTGCACCTGCAGCCACTG

CGCTCTGCTGCTGGGGCCGCCGCCCTGGCTTTGACCGTGGACCTGCCACC

CGCCTCCTCCGAGGCTCGGAACTCGGCCTTCGGTTTCCAGGGCCGCTTGC

TGCACCTGAGTGCCGGCCAGCGCCTGGGCGTCCATCTTCACACTGAGGCC

AGGGCACGCCATGCCTGGCAGCTTACCCAGGGCGCCACAGTCTTGGGACT

CTTCCGGGTGACCCCCGAAATCCCAGCCGGACTCCCTTCACCGAGGTCGG

AA.

In some embodiments of these multi-chain chimeric polypeptides, a soluble human CD137L includes a sequence that is at least 80% identical (e.g., at least 85%, at least 90%, at least 95%, at least 96%, at least 97%, at least 98%, at least 99%, or 100% identical) to:

(SEQ ID NO: 262)
DPAGLLDLRQGMFAQLVAQNVLLIDGPLSWYSDPGLAGVSLTGGLSYKED

TKELVVAKAGVYYVFFQLELRRVVAGEGSGSVSLALHLQPLRSAAGAAAL

ALTVDLPPASSEARNSAFGFQGRLLHLSAGQRLGVHLHTEARARHAWQLT

QGATVLGLFRVTPEI.

In some embodiments of these multi-chain chimeric polypeptides, a soluble human CD137L is encoded by a sequence that is at least 80% identical (e.g., at least 85%, at least 90%, at least 95%, at least 96%, at least 97%, at least 98%, at least 99%, or 100% identical) to:

(SEQ ID NO: 263)
GATCCCGCCGGCCTCTTGGACCTGCGGCAGGGCATGTTTGCGCAGCTGGT

GGCCCAAAATGTTCTGCTGATCGATGGGCCCCTGAGCTGGTACAGTGACC

CAGGCCTGGCAGGCGTGTCCCTGACGGGGGGCCTGAGCTACAAAGAGGAC

ACGAAGGAGCTGGTGGTGGCCAAGGCTGGAGTCTACTATGTCTTCTTTCA

ACTAGAGCTGCGGCGCGTGGTGGCCGGCGAGGGCTCAGGCTCCGTTTCAC

TTGCGCTGCACCTGCAGCCACTGCGCTCTGCTGCTGGGGCCGCCGCCCTG

GCTTTGACCGTGGACCTGCCACCCGCCTCCTCCGAGGCTCGGAACTCGGC

CTTCGGTTTCCAGGGCCGCTTGCTGCACCTGAGTGCCGGCCAGCGCCTGG

GCGTCCATCTTCACACTGAGGCCAGGGCACGCCATGCCTGGCAGCTTACC

CAGGGCGCCACAGTCTTGGGACTCTTCCGGGTGACCCCCGAAATC.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 236)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPDSGTTNTVAAYNLT

WKSTNFKTILEWEPKPVNQVYTVQISTKSGDWKSKCFYTTDTECDLTDEI

VKDVKQTYLARVFSYPAGNVESTGSAGEPLYENSPEFTPYLETNLGQPTI

QSFEQVGTKVNVTVEDERTLVRRNNTFLSLRDVFGKDLIYTLYYWKSSSS

GKKTAKTNTNEFLIDVDKGENYCFSVQAVIPSRTVNRKSTDSPVECMGQE

KGEFRENWVNVISDLKKIEDLIQSMHIDATLYTESDVHPSCKVTAMKCFL

LELQVISLESGDASIHDTVENLIILANNSLSSNGNVTESGCKECEELEEK

NIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 237)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGACAGCGGCACAACCAACACAGTCGCTGCCTATAACCTCACT

TGGAAGAGCACCAACTTCAAAACCATCCTCGAATGGGAACCCAAACCCGT

TAACCAAGTTTACACCGTGCAGATCAGCACCAAGTCCGGCGACTGGAAGT

CCAAATGTTTCTATACCACCGACACCGAGTGCGATCTCACCGATGAGATC

GTGAAAGATGTGAAACAGACCTACCTCGCCCGGGTGTTTAGCTACCCCGC

CGGCAATGTGGAGAGCACTGGTTCCGCTGGCGAGCCTTTATACGAGAACA

GCCCCGAATTTACCCCTTACCTCGAGACCAATTTAGGACAGCCCACCATC

CAAAGCTTTGAGCAAGTTGGCACAAAGGTGAATGTGACAGTGGAGGACGA

GCGGACTTTAGTGCGGCGGAACAACACCTTTCTCAGCCTCCGGGATGTGT

TCGGCAAAGATTTAATCTACACACTGTATTACTGGAAGTCCTCTTCCTCC

GGCAAGAAGACAGCTAAAACCAACACAAACGAGTTTTTAATCGACGTGGA

TAAAGGCGAAAACTACTGTTTCAGCGTGCAAGCTGTGATCCCCTCCCGGA

CCGTGAATAGGAAAAGCACCGATAGCCCCGTTGAGTGCATGGGCCAAGAA

AAGGGCGAGTTCCGGGAGAACTGGGTGAACGTCATCAGCGATTTAAAGAA

GATCGAAGATTTAATTCAGTCCATGCATATCGACGCCACTTTATACACAG

```
AATCCGACGTGCACCCCTCTTGTAAGGTGACCGCCATGAAATGTTTTTA

CTGGAGCTGCAAGTTATCTCTTTAGAGAGCGGAGACGCTAGCATCCACGA

CACCGTGGAGAATTTAATCATTTTAGCCAATAACTCTTTATCCAGCAACG

GCAACGTGACAGAGTCCGGCTGCAAGGAGTGCGAAGAGCTGGAGGAGAAG

AACATCAAGGAGTTTCTGCAATCCTTTGTGCACATTGTCCAGATGTTCAT

CAATACCTCC.
```

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 238)
MKWVTFISLLFLFSSAYSIPPHVQKSVNNDMIVTDNNGAVKFPQLCKFCD

VRFSTCDNQKSCMSNCSITSICEKPQEVCVAVWRKNDENITLETVCHDPK

LPYHDFILEDAASPKCIMKEKKKPGETFFMCSCSSDECNDNIIFSEEYNT

SNPDGGGGSGGGGSGGGGSIPPHVQKSVNNDMIVTDNNGAVKFPQLCKFC

DVRFSTCDNQKSCMSNCSITSICEKPQEVCVAVWRKNDENITLETVCHDP

KLPYHDFILEDAASPKCIMKEKKKPGETFFMCSCSSDECNDNIIFSEEYN

TSNPDSGTTNTVAAYNLTWKSTNFKTILEWEPKPVNQVYTVQISTKSGDW

KSKCFYTTDTECDLTDEIVKDVKQTYLARVFSYPAGNVESTGSAGEPLYE

NSPEFTPYLETNLGQPTIQSFEQVGTKVNVTVEDERTLVRRNNTFLSLRD

VFGKDLIYTLYYWKSSSSGKKTAKTNTNEFLIDVDKGENYCFSVQAVIPS

RTVNRKSTDSPVECMGQEKGEFRENWVNVISDLKKIEDLIQSMHIDATLY

TESDVHPSCKVTAMKCFLLELQVISLESGDASIHDTVENLIILANNSLSS

NGNVTESGCKECEELEEKNIKEFLQSFVHIVQMFINTS.
```

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 239)
ATGAAGTGGGTGACCTTCATCAGCCTGCTGTTCCTGTTCTCCAGCGCCTA

CTCCATCCCCCCCCATGTGCAAAAGAGCGTGAACAACGATATGATCGTGA

CCGACAACAACGGCGCCGTGAAGTTTCCCCAGCTCTGCAAGTTCTGCGAT

GTCAGGTTCAGCACCTGCGATAATCAGAAGTCCTGCATGTCCAACTGCAG

CATCACCTCCATCTGCGAGAAGCCCCAAGAAGTGTGCGTGGCCGTGTGGC

GGAAAAATGACGAGAACATCACCCTGGAGACCGTGTGTCACGACCCCAAG

CTCCCTTATCACGACTTCATTCTGGAGGACGCTGCCTCCCCCAAATGCAT

CATGAAGGAGAAGAAGAAGCCCGGAGAGACCTTCTTTATGTGTTCCTGTA

GCAGCGACGAGTGTAACGACAACATCATCTTCAGCGAAGAGTACAACACC

AGCAACCCTGATGGAGGTGGCGGATCCGGAGGTGGAGGTTCTGGTGGAGG

TGGGAGTATTCCTCCCCACGTGCAGAAGAGCGTGAATAATGACATGATCG

TGACCGATAACAATGGCGCCGTGAAATTTCCCCAGCTGTGCAAATTCTGC

GATGTGAGGTTTTCCACCTGCGACAACCAGAAGTCCTGTATGAGCAACTG

CTCCATCACCTCCATCTGTGAGAAGCCTCAGGAGGTGTGCGTGGCTGTCT

GGCGGAAGAATGACGAGAATATCACCCTGGAAACCGTCTGCCACGATCCC

AAGCTGCCCTACCACGATTTCATCCTGGAAGACGCCGCCAGCCCTAAGTG

CATCATGAAAGAGAAAAAGAAGCCTGGCGAGACCTTTTTCATGTGCTCCT

GCAGCAGCGACGAATGCAACGACAATATCATCTTTAGCGAGGAATACAAT

ACCAGCAACCCCGACAGCGGCACAACCAACACAGTCGCTGCCTATAACCT

CACTTGGAAGAGCACCAACTTCAAAACCATCCTCGAATGGGAACCCAAAC

CCGTTAACCAAGTTTACACCGTGCAGATCAGCACCAAGTCCGGCGACTGG

AAGTCCAAATGTTTCTATACCACCGACACCGAGTGCGATCTCACCGATGA

GATCGTGAAAGATGTGAAACAGACCTACCTCGCCCGGGTGTTTAGCTACC

CCGCCGGCAATGTGGAGAGCACTGGTTCCGCTGGCGAGCCTTTATACGAG

AACAGCCCCGAATTTACCCCTTACCTCGAGACCAATTTAGGACAGCCCAC

CATCCAAAGCTTTGAGCAAGTTGGCACAAAGGTGAATGTGACAGTGGAGG

ACGAGCGGACTTTAGTGCGGCGGAACAACACCTTTCTCAGCCTCCGGGAT

GTGTTCGGCAAAGATTTAATCTACACACTGTATTACTGGAAGTCCTCTTC

CTCCGGCAAGAAGACAGCTAAAACCAACACAAACGAGTTTTTAATCGACG

TGGATAAAGGCGAAAACTACTGTTTCAGCGTGCAAGCTGTGATCCCCTCC

CGGACCGTGAATAGGAAAAGCACCGATAGCCCCGTTGAGTGCATGGGCCA

AGAAAAGGGCGAGTTCCGGGAGAACTGGGTGAACGTCATCAGCGATTTAA

AGAAGATCGAAGATTTAATTCAGTCCATGCATATCGACGCCACTTTATAC

ACAGAATCCGACGTGCACCCCTCTTGTAAGGTGACCGCCATGAAATGTTT

TTTACTGGAGCTGCAAGTTATCTCTTTAGAGAGCGGAGACGCTAGCATCC

ACGACACCGTGGAGAATTTAATCATTTTAGCCAATAACTCTTTATCCAGC

AACGGCAACGTGACAGAGTCCGGCTGCAAGGAGTGCGAAGAGCTGGAGGA

GAAGAACATCAAGGAGTTTCTGCAATCCTTTGTGCACATTGTCCAGATGT

TCATCAATACCTCC.
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 268)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDSITCPPPMSVEHADIWVK

SYSLYSRERYICNSGFKRKAGTSSLTECVLNKATNVAHWTTPSLKCIRGG

GGSGGGGSGGGGSREGPELSPDDPAGLLDLRQGMFAQLVAQNVLLIDGPL
```

-continued
SWYSDPGLAGVSLTGGLSYKEDTKELVVAKAGVYYVFFQLELRRVVAGEG

SGSVSLALHLQPLRSAAGAAALALTVDLPPASSEARNSAFGFQGRLLHLS

AGQRLGVHLHTEARARHAWQLTQGATVLGLFRVTPEIPAGLPSPRSE.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 269)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCAAGGAGTTCCTGGAGAGGTTCAAGTCCCTGCTGCAGAA

GATGATCCATCAGCACCTGTCCTCCAGGACCCACGGCTCCGAGGACTCCA

TTACATGCCCCCCTCCCATGAGCGTGGAGCACGCCGACATCTGGGTGAAG

AGCTATAGCCTCTACAGCCGGGAGAGGTATATCTGTAACAGCGGCTTCAA

GAGGAAGGCCGGCACCAGCAGCCTCACCGAGTGCGTGCTGAATAAGGCTA

CCAACGTGGCTCACTGGACAACACCCTCTTTAAAGTGCATCCGGGGCGGT

GGAGGATCCGGAGGAGGTGGCTCCGGCGGCGGAGGATCTCGCGAGGGTCC

CGAGCTTTCGCCCGACGATCCCGCCGGCCTCTTGGACCTGCGGCAGGGCA

TGTTTGCGCAGCTGGTGGCCCAAAATGTTCTGCTGATCGATGGGCCCCTG

AGCTGGTACAGTGACCCAGGCCTGGCAGGCGTGTCCCTGACGGGGGGCCT

GAGCTACAAAGAGGACACGAAGGAGCTGGTGGTGGCCAAGGCTGGAGTCT

ACTATGTCTTCTTTCAACTAGAGCTGCGGCGCGTGGTGGCCGGCGAGGGC

TCAGGCTCCGTTTCACTTGCGCTGCACCTGCAGCCACTGCGCTCTGCTGC

TGGGGCCGCCGCCCTGGCTTTGACCGTGGACCTGCCACCCGCCTCCTCCG

AGGCTCGGAACTCGGCCTTCGGTTTCCAGGGCCGCTTGCTGCACCTGAGT

GCCGGCCAGCGCCTGGGCGTCCATCTTCACACTGAGGCCAGGGCACGCCA

TGCCTGGCAGCTTACCCAGGGCGCCACAGTCTTGGGACTCTTCCGGGTGA

CCCCCGAAATCCCAGCCGGACTCCCTTCACCGAGGTCGGAA.

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 270)
MKWVTFISLLFLFSSAYSQGQDRHMIRMRQLIDIVDQLKNYVNDLVPEFL

PAPEDVETNCEWSAFSCFQKAQLKSANTGNNERIINVSIKKLKRKPPSTN

AGRRQKHRLTCPSCDSYEKKPPKEFLERFKSLLQKMIHQHLSSRTHGSED

SITCPPPMSVEHADIWVKSYSLYSRERYICNSGFKRKAGTSSLTECVLNK

ATNVAHWTTPSLKCIRGGGGSGGGGSGGGGSREGPELSPDDPAGLLDLRQ

GMFAQLVAQNVLLIDGPLSWYSDPGLAGVSLTGGLSYKEDTKELVVAKAG

VYYVFFQLELRRVVAGEGSGSVSLALHLQPLRSAAGAAALALTVDLPPAS

SEARNSAFGFQGRLLHLSAGQRLGVHLHTEARARHAWQLTQGATVLGLFR

VTPEIPAGLPSPRSE.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 271)
ATGAAGTGGGTGACCTTCATCAGCCTGCTGTTCCTGTTCTCCAGCGCCTA

CTCCCAGGGCCAGGACAGGCACATGATCCGGATGAGGCAGCTCATCGACA

TCGTCGACCAGCTGAAGAACTACGTGAACGACCTGGTGCCCGAGTTTCTG

CCTGCCCCCGAGGACGTGGAGACCAACTGCGAGTGGTCCGCCTTCTCCTG

CTTTCAGAAGGCCCAGCTGAAGTCCGCCAACACCGGCAACAACGAGCGGA

TCATCAACGTGAGCATCAAGAAGCTGAAGCGGAAGCCTCCCTCCACAAAC

GCCGGCAGGAGGCAGAAGCACAGGCTGACCTGCCCCAGCTGTGACTCCTA

CGAGAAGAAGCCCCCAAGGAGTTCCTGGAGAGGTTCAAGTCCCTGCTGC

AGAAGATGATCCATCAGCACCTGTCCTCCAGGACCCACGGCTCCGAGGAC

TCCATTACATGCCCCCCTCCCATGAGCGTGGAGCACGCCGACATCTGGGT

GAAGAGCTATAGCCTCTACAGCCGGGAGAGGTATATCTGTAACAGCGGCT

TCAAGAGGAAGGCCGGCACCAGCAGCCTCACCGAGTGCGTGCTGAATAAG

GCTACCAACGTGGCTCACTGGACAACACCCTCTTTAAAGTGCATCCGGGG

CGGTGGAGGATCCGGAGGAGGTGGCTCCGGCGGCGGAGGATCTCGCGAGG

GTCCCGAGCTTTCGCCCGACGATCCCGCCGGCCTCTTGGACCTGCGGCAG

GGCATGTTTGCGCAGCTGGTGGCCCAAAATGTTCTGCTGATCGATGGGCC

CCTGAGCTGGTACAGTGACCCAGGCCTGGCAGGCGTGTCCCTGACGGGGG

GCCTGAGCTACAAAGAGGACACGAAGGAGCTGGTGGTGGCCAAGGCTGGA

GTCTACTATGTCTTCTTTCAACTAGAGCTGCGGCGCGTGGTGGCCGGCGA

GGGCTCAGGCTCCGTTTCACTTGCGCTGCACCTGCAGCCACTGCGCTCTG

CTGCTGGGGCCGCCGCCCTGGCTTTGACCGTGGACCTGCCACCCGCCTCC

TCCGAGGCTCGGAACTCGGCCTTCGGTTTCCAGGGCCGCTTGCTGCACCT

GAGTGCCGGCCAGCGCCTGGGCGTCCATCTTCACACTGAGGCCAGGGCAC

GCCATGCCTGGCAGCTTACCCAGGGCGCCACAGTCTTGGGACTCTTCCGG

GTGACCCCCGAAATCCCAGCCGGACTCCCTTCACCGAGGTCGGAA.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 272)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDSITCPPPMSVEHADIWVK

SYSLYSRERYICNSGFKRKAGTSSLTECVLNKATNVAHWTTPSLKCIRGG

GGSGGGGSGGGGSDPAGLLDLRQGMFAQLVAQNVLLIDGPLSWYSDPGLA

GVSLTGGLSYKEDTKELVVAKAGVYYVFFQLELRRVVAGEGSGSVSLALH

LQPLRSAAGAAALALTVDLPPASSEARNSAFGFQGRLLHLSAGQRLGVHL

HTEARARHAWQLTQGATVLGLFRVTPEI.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 273)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCCAAGGAGTTCCTGGAGAGGTTCAAGTCCCTGCTGCAGAA

GATGATCCATCAGCACCTGTCCTCCAGGACCCACGGCTCCGAGGACTCCA

TTACATGCCCCCCTCCCATGAGCGTGGAGCACGCCGACATCTGGGTGAAG

AGCTATAGCCTCTACAGCCGGGAGAGGTATATCTGTAACAGCGGCTTCAA

GAGGAAGGCCGGCACCAGCAGCCTCACCGAGTGCGTGCTGAATAAGGCTA

CCAACGTGGCTCACTGGACAACACCCTCTTTAAAGTGCATCCGGGGCGGT

GGAGGATCCGGAGGAGGTGGCTCCGGCGGCGGAGGATCTGATCCCGCCGG

CCTCTTGGACCTGCGGCAGGGCATGTTTGCGCAGCTGGTGGCCCAAATG

TTCTGCTGATCGATGGGCCCCTGAGCTGGTACAGTGACCCAGGCCTGGCA

GGCGTGTCCCTGACGGGGGGCCTGAGCTACAAAGAGGACACGAAGGAGCT

GGTGGTGGCCAAGGCTGGAGTCTACTATGTCTTCTTTCAACTAGAGCTGC

GGCGCGTGGTGGCCGGCGAGGGCTCAGGCTCCGTTTCACTTGCGCTGCAC

CTGCAGCCACTGCGCTCTGCTGCTGGGGCCGCCGCCCTGGCTTTGACCGT

GGACCTGCCACCCGCCTCCTCCGAGGCTCGGAACTCGGCCTTCGGTTTCC

AGGGCCGCTTGCTGCACCTGAGTGCCGGCCAGCGCCTGGGCGTCCATCTT

CACACTGAGGCCAGGGCACGCCATGCCTGGCAGCTTACCCAGGGCGCCAC

AGTCTTGGGACTCTTCCGGGTGACCCCCGAAATC.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 274)
MKWVTFISLLFLFSSAYSQGQDRHMIRMRQLIDIVDQLKNYVNDLVPEFL

PAPEDVETNCEWSAFSCFQKAQLKSANTGNNERIINVSIKKLKRKPPSTN

AGRRQKHRLTCPSCDSYEKKPPKEFLERFKSLLQKMIHQHLSSRTHGSED

SITCPPPMSVEHADIWVKSYSLYSRERYICNSGFKRKAGTSSLTECVLNK

ATNVAHWTTPSLKCIRGGGGSGGGGGGGSDPAGLLDLRQGMFAQLVAQN

VLLIDGPLSWYSDPGLAGVSLTGGLSYKEDTKELVVAKAGVYYVFFQLEL

RRVVAGEGSGSVSLALHLQPLRSAAGAAALALTVDLPPASSEARNSAFGF

QGRLLHLSAGQRLGVHLHTEARARHAWQLTQGATVLGLFRVTPEI.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 275)
ATGAAGTGGGTGACCTTCATCAGCCTGCTGTTCCTGTTCTCCAGCGCCTA

CTCCCAGGGCCAGGACAGGCACATGATCCGGATGAGGCAGCTCATCGACA

TCGTCGACCAGCTGAAGAACTACGTGAACGACCTGGTGCCCGAGTTTCTG

CCTGCCCCCGAGGACGTGGAGACCAACTGCGAGTGGTCCGCCTTCTCCTG

CTTTCAGAAGGCCCAGCTGAAGTCCGCCAACACCGGCAACAACGAGCGGA

TCATCAACGTGAGCATCAAGAAGCTGAAGCGGAAGCCTCCCTCCACAAAC

GCCGGCAGGAGGCAGAAGCACAGGCTGACCTGCCCCAGCTGTGACTCCTA

CGAGAAGAAGCCCCCCAAGGAGTTCCTGGAGAGGTTCAAGTCCCTGCTGC

AGAAGATGATCCATCAGCACCTGTCCTCCAGGACCCACGGCTCCGAGGAC

TCCATTACATGCCCCCCTCCCATGAGCGTGGAGCACGCCGACATCTGGGT

GAAGAGCTATAGCCTCTACAGCCGGGAGAGGTATATCTGTAACAGCGGCT

TCAAGAGGAAGGCCGGCACCAGCAGCCTCACCGAGTGCGTGCTGAATAAG

GCTACCAACGTGGCTCACTGGACAACACCCTCTTTAAAGTGCATCCGGGG

CGGTGGAGGATCCGGAGGAGGTGGCTCCGGCGGCGGAGGATCTGATCCCG

CCGGCCTCTTGGACCTGCGGCAGGGCATGTTTGCGCAGCTGGTGGCCCAA

ATGTTCTGCTGATCGATGGGCCCCTGAGCTGGTACAGTGACCCAGGCCT

GGCAGGCGTGTCCCTGACGGGGGGCCTGAGCTACAAAGAGGACACGAAGG

AGCTGGTGGTGGCCAAGGCTGGAGTCTACTATGTCTTCTTTCAACTAGAG

CTGCGGCGCGTGGTGGCCGGCGAGGGCTCAGGCTCCGTTTCACTTGCGCT

GCACCTGCAGCCACTGCGCTCTGCTGCTGGGGCCGCCGCCCTGGCTTTGA

CCGTGGACCTGCCACCCGCCTCCTCCGAGGCTCGGAACTCGGCCTTCGGT

TTCCAGGGCCGCTTGCTGCACCTGAGTGCCGGCCAGCGCCTGGGCGTCCA

-continued

```
TCTTCACACTGAGGCCAGGGCACGCCATGCCTGGCAGCTTACCCAGGGCG

CCACAGTCTTGGGACTCTTCCGGGTGACCCCCGAAATC.
```

Exemplary Multi-Chain Chimeric Polypeptides—Type M

In some embodiments of any of the multi-chain chimeric polypeptides described herein, the first target-binding domain and the second targeting-binding domain each independently bind specifically to TGF-β or a receptor of IL-21. In some embodiments of these multi-chain chimeric polypeptides described herein, the second chimeric polypeptide further includes the additional target-binding domain. In some embodiments of these multi-chain chimeric polypeptides described herein, the additional target-binding domain binds specifically to a receptor for IL-21 (e.g., a soluble IL-21, e.g., a soluble human IL-21) or a TGF-β (e.g., a soluble TGF-β receptor, e.g., a soluble TGFβRII receptor).

In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments, the second chimeric polypeptide further comprises one or more additional target-binding domains at the N-terminal end or the C-terminal end of the second chimeric polypeptide.

In some embodiments of these multi-chain chimeric polypeptides, the additional target-binding domain and the second domain of the pair of affinity domains directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the additional target-binding domain in the second chimeric polypeptide.

In some embodiments of these multi-chain chimeric polypeptides, the additional target-binding domain and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second target-binding domain and the additional target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, the first target-binding domain binds specifically to TGF-β, and the second target-binding domain binds specifically to TGF-β or a receptor for IL-21. In some embodiments of these multi-chain chimeric polypeptides, the first target-binding domain is a soluble TGF-β receptor (e.g., a soluble TGFβRII receptor, e.g., a soluble human TGFβRII receptor). In some embodiments of these multi-chain chimeric polypeptides, the soluble human TGFRβRII includes a first sequence of soluble human TGFRβRII and a second sequence of soluble human TGFRβRII. In some embodiments of these multi-chain chimeric polypeptides, the soluble human TGFRβRII includes a linker disposed between the first sequence of soluble human TGFRβRII and the second sequence of soluble human TGFRβRII. In some examples of these multi-chain chimeric polypeptides, the linker includes the sequence GGGGSGGGGSGGGGS (SEQ ID NO: 102).

In some embodiments of these multi-chain chimeric polypeptides, the first sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 183)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the second sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 184)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the first sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 185)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGAT.

In some embodiments of these multi-chain chimeric polypeptides, the second sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 186)
ATTCCTCCCCACGTGCAGAAGAGCGTGAATAATGACATGATCGTGACCGA

TAACAATGGCGCCGTGAAATTTCCCCAGCTGTGCAAATTCTGCGATGTGA

GGTTTTCCACCTGCGACAACCAGAAGTCCTGTATGAGCAACTGCTCCATC

ACCTCCATCTGTGAGAAGCCTCAGGAGGTGTGCGTGGCTGTCTGGCGGAA

GAATGACGAGAATATCACCCTGGAAACCGTCTGCCACGATCCCAAGCTGC

CCTACCACGATTTCATCCTGGAAGACGCCGCCAGCCCTAAGTGCATCATG

AAAGAGAAAAAGAAGCCTGGCGAGACCTTTTTCATGTGCTCCTGCAGCAG

CGACGAATGCAACGACAATATCATCTTTAGCGAGGAATACAATACCAGCA

ACCCCGAC.

In some embodiments of these multi-chain chimeric polypeptides, the soluble TGF-β receptor includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 188)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD.

In some embodiments of these multi-chain chimeric polypeptides, the soluble TGF-β receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 187)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGAC.

In some embodiments of these multi-chain chimeric polypeptides, the second target-binding domain binds specifically to a receptor for IL-21. In some embodiments of these multi-chain chimeric polypeptides, the second target-binding domain includes a soluble IL-21 (e.g., a human soluble IL-21). In some embodiments of these multi-chain chimeric polypeptides, the soluble IL-21 includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 83)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS.

In some embodiments of these multi-chain chimeric polypeptides, the soluble IL-21 is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 182)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

-continued

```
CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCAAGGAGTTCCTGGAGAGGTTCAAGTCCCTGCTGCAGAA

GATGATCCATCAGCACCTGTCCTCCAGGACCCACGGCTCCGAGGACTCC.
```

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 236)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPDSGTTNTVAAYNLT

WKSTNFKTILEWEPKPVNQVYTVQISTKSGDWKSKCFYTTDTECDLTDEI

VKDVKQTYLARVFSYPAGNVESTGSAGEPLYENSPEFTPYLETNLGQPTI

QSFEQVGTKVNVTVEDERTLVRRNNTFLSLRDVFGKDLIYTLYYWKSSSS

GKKTAKTNTNEFLIDVDKGENYCFSVQAVIPSRTVNRKSTDSPVECMGQE

KGEFRENWVNVISDLKKIEDLIQSMHIDATLYTESDVHPSCKVTAMKCFL

LELQVISLESGDASIHDTVENLIILANNSLSSNGNVTESGCKECEELEEK

NIKEFLQSFVHIVQMFINTS.
```

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 237)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGACAGCGGCACAACCAACACAGTCGCTGCCTATAACCTCACT

TGGAAGAGCACCAACTTCAAAACCATCCTCGAATGGGAACCCAAACCCGT

TAACCAAGTTTACACCGTGCAGATCAGCACCAAGTCCGGCGACTGGAAGT

CCAAATGTTTCTATACCACCGACACCGAGTGCGATCTCACCGATGAGATC

GTGAAAGATGTGAAACAGACCTACCTCGCCCGGGTGTTTAGCTACCCCGC

CGGCAATGTGGAGAGCACTGGTTCCGCTGGCGAGCCTTTATACGAGAACA

GCCCCGAATTTACCCCTTACCTCGAGACCAATTTAGGACAGCCCACCATC

CAAAGCTTTGAGCAAGTTGGCACAAAGGTGAATGTGACAGTGGAGGACGA

GCGGACTTTAGTGCGGCGGAACAACACCTTTCTCAGCCTCCGGGATGTGT

TCGGCAAAGATTTAATCTACACACTGTATTACTGGAAGTCCTCTTCCTCC

GGCAAGAAGACAGCTAAAACCAACACAAACGAGTTTTTAATCGACGTGGA

TAAAGGCGAAAACTACTGTTTCAGCGTGCAAGCTGTGATCCCCTCCCGGA

CCGTGAATAGGAAAAGCACCGATAGCCCCGTTGAGTGCATGGGCCAAGAA

AAGGGCGAGTTCCGGGAGAACTGGGTGAACGTCATCAGCGATTTAAAGAA

GATCGAAGATTTAATTCAGTCCATGCATATCGACGCCACTTTATACACAG

AATCCGACGTGCACCCCTCTTGTAAGGTGACCGCCATGAAATGTTTTTTA

CTGGAGCTGCAAGTTATCTCTTTAGAGAGCGGAGACGCTAGCATCCACGA

CACCGTGGAGAATTTAATCATTTTAGCCAATAACTCTTTATCCAGCAACG

GCAACGTGACAGAGTCCGGCTGCAAGGAGTGCGAAGAGCTGGAGGAGAAG

AACATCAAGGAGTTTCTGCAATCCTTTGTGCACATTGTCCAGATGTTCAT

CAATACCTCC.
```

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or

```
                                      (SEQ ID NO: 238)
MKWVTFISLLFLFSSAYSIPPHVQKSVNNDMIVTDNNGAVKFPQLCKFCD

VRFSTCDNQKSCMSNCSITSICEKPQEVCVAVWRKNDENITLETVCHDPK

LPYHDFILEDAASPKCIMKEKKKPGETFFMCSCSSDECNDNIIFSEEYNT

SNPDGGGGSGGGGSGGGGSIPPHVQKSVNNDMIVTDNNGAVKFPQLCKFC

DVRFSTCDNQKSCMSNCSITSICEKPQEVCVAVWRKNDENITLETVCHDP

KLPYHDFILEDAASPKCIMKEKKKPGETFFMCSCSSDECNDNIIFSEEYN
```

TSNPDSGTTNTVAAYNLTWKSTNFKTILEWEPKPVNQVYTVQISTKSGDW
KSKCFYTTDTECDLTDEIVKDVKQTYLARVFSYPAGNVESTGSAGEPLYE
NSPEFTPYLETNLGQPTIQSFEQVGTKVNVTVEDERTLVRRNNTFLSLRD
VFGKDLIYTLYYWKSSSSGKKTAKTNTNEFLIDVDKGENYCFSVQAVIPS
RTVNRKSTDSPVECMGQEKGEFRENWVNVISDLKKIEDLIQSMHIDATLY
TESDVHPSCKVTAMKCFLLELQVISLESGDASIHDTVENLIILANNSLSS
NGNVTESGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 239)
ATGAAGTGGGTGACCTTCATCAGCCTGCTGTTCCTGTTCTCCAGCGCCTA
CTCCATCCCCCCCCATGTGCAAAAGAGCGTGAACAACGATATGATCGTGA
CCGACAACAACGGCGCCGTGAAGTTTCCCCAGCTCTGCAAGTTCTGCGAT
GTCAGGTTCAGCACCTGCGATAATCAGAAGTCCTGCATGTCCAACTGCAG
CATCACCTCCATCTGCGAGAAGCCCCAAGAAGTGTGCGTGGCCGTGTGGC
GGAAAAATGACGAGAACATCACCCTGGAGACCGTGTGTCACGACCCCAAG
CTCCCTTATCACGACTTCATTCTGGAGGACGCTGCCTCCCCCAAATGCAT
CATGAAGGAGAAGAAGAAGCCCGGAGAGACCTTCTTTATGTGTTCCTGTA
GCAGCGACGAGTGTAACGACAACATCATCTTCAGCGAAGAGTACAACACC
AGCAACCCTGATGGAGGTGGCGGATCCGGAGGTGGAGGTTCTGGTGGAGG
TGGGAGTATTCCTCCCCACGTGCAGAAGAGCGTGAATAATGACATGATCG
TGACCGATAACAATGGCGCCGTGAAATTTCCCCAGCTGTGCAAATTCTGC
GATGTGAGGTTTTCCACCTGCGACAACCAGAAGTCCTGTATGAGCAACTG
CTCCATCACCTCCATCTGTGAGAAGCCTCAGGAGGTGTGCGTGGCTGTCT
GGCGGAAGAATGACGAGAATATCACCCTGGAAACCGTCTGCCACGATCCC
AAGCTGCCCTACCACGATTTCATCCTGGAAGACGCCGCCAGCCCTAAGTG
CATCATGAAAGAGAAAAAGAAGCCTGGCGAGACCTTTTTCATGTGCTCCT
GCAGCAGCGACGAATGCAACGACAATATCATCTTTAGCGAGGAATACAAT
ACCAGCAACCCCGACAGCGGCACAACCAACACAGTCGCTGCCTATAACCT
CACTTGGAAGAGCACCAACTTCAAAACCATCCTCGAATGGGAACCCAAAC
CCGTTAACCAAGTTTACACCGTGCAGATCAGCACCAAGTCCGGCGACTGG
AAGTCCAAATGTTTCTATACCACCGACACCGAGTGCGATCTCACCGATGA
GATCGTGAAAGATGTGAAACAGACCTACCTCGCCCGGGTGTTTAGCTACC
CCGCCGGCAATGTGGAGAGCACTGGTTCCGCTGGCGAGCCTTTATACGAG
AACAGCCCCGAATTTACCCCTTACCTCGAGACCAATTTAGGACAGCCCAC
CATCCAAAGCTTTGAGCAAGTTGGCACAAAGGTGAATGTGACAGTGGAGG
ACGAGCGGACTTTAGTGCGGCGGAACAACACCTTTCTCAGCCTCCGGGAT
GTGTTCGGCAAAGATTTAATCTACACACTGTATTACTGGAAGTCCTCTTC

CTCCGGCAAGAAGACAGCTAAAACCAACACAAACGAGTTTTTAATCGACG
TGGATAAAGGCGAAAACTACTGTTTCAGCGTGCAAGCTGTGATCCCCTCC
CGGACCGTGAATAGGAAAAGCACCGATAGCCCCGTTGAGTGCATGGGCCA
AGAAAAGGGCGAGTTCCGGGAGAACTGGGTGAACGTCATCAGCGATTTAA
AGAAGATCGAAGATTTAATTCAGTCCATGCATATCGACGCCACTTTATAC
ACAGAATCCGACGTGCACCCCTCTTGTAAGGTGACCGCCATGAAATGTTT
TTTACTGGAGCTGCAAGTTATCTCTTTAGAGAGCGGAGACGCTAGCATCC
ACGACACCGTGGAGAATTTAATCATTTTAGCCAATAACTCTTTATCCAGC
AACGGCAACGTGACAGAGTCCGGCTGCAAGGAGTGCGAAGAGCTGGAGGA
GAAGAACATCAAGGAGTTTCTGCAATCCTTTGTGCACATTGTCCAGATGT
TCATCAATACCTCC.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 300)
IPPHVQKSVNNDMIVTDNNGAVKFPQLCKFCDVRFSTCDNQKSCMSNCSI
TSICEKPQEVCVAVWRKNDENITLETVCHDPKLPYHDFILEDAASPKCIM
KEKKKPGETFFMCSCSSDECNDNIIFSEEYNTSNPDGGGGSGGGGSGGGG
SIPPHVQKSVNNDMIVTDNNGAVKFPQLCKFCDVRFSTCDNQKSCMSNCS
ITSICEKPQEVCVAVWRKNDENITLETVCHDPKLPYHDFILEDAASPKCI
MKEKKKPGETFFMCSCSSDECNDNIIFSEEYNTSNPDITCPPPMSVEHAD
IWVKSYSLYSRERYICNSGFKRKAGTSSLTECVLNKATNVAHWTTPSLKC
IRQGQDRHMIRMRQLIDIVDQLKNYVNDLVPEFLPAPEDVETNCEWSAFS
CFQKAQLKSANTGNNERIINVSIKKLKRKPPSTNAGRRQKHRLTCPSCDS
YEKKPPKEFLERFKSLLQKMIHQHLSSRTHGSEDS.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 301)
ATCCCCCCCCATGTGCAAAAGAGCGTGAACAACGATATGATCGTGACCGA
CAACAACGGCGCCGTGAAGTTTCCCCAGCTCTGCAAGTTCTGCGATGTCA
GGTTCAGCACCTGCGATAATCAGAAGTCCTGCATGTCCAACTGCAGCATC
ACCTCCATCTGCGAGAAGCCCCAAGAAGTGTGCGTGGCCGTGTGGCGGAA
AAATGACGAGAACATCACCCTGGAGACCGTGTGTCACGACCCCAAGCTCC
CTTATCACGACTTCATTCTGGAGGACGCTGCCTCCCCCAAATGCATCATG
AAGGAGAAGAAGAAGCCCGGAGAGACCTTCTTTATGTGTTCCTGTAGCAG

-continued

```
CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAGAAGCCTGGCGAGACCTTTTTCATGTGCTCCTGCAG

CAGCGACGAATGCAACGACAATATCATCTTTAGCGAGGAATACAATACCA

GCAACCCCGACATTACATGCCCCCCTCCCATGAGCGTGGAGCACGCCGAC

ATCTGGGTGAAGAGCTATAGCCTCTACAGCCGGGAGAGGTATATCTGTAA

CAGCGGCTTCAAGAGGAAGGCCGGCACCAGCAGCCTCACCGAGTGCGTGC

TGAATAAGGCTACCAACGTGGCTCACTGGACAACACCCTCTTTAAAGTGC

ATCCGGCAGGGCCAGGACAGGCACATGATCCGGATGAGGCAGCTCATCGA

CATCGTCGACCAGCTGAAGAACTACGTGAACGACCTGGTGCCCGAGTTTC

TGCCTGCCCCCGAGGACGTGGAGACCAACTGCGAGTGGTCCGCCTTCTCC

TGCTTTCAGAAGGCCCAGCTGAAGTCCGCCAACACCGGCAACAACGAGCG

GATCATCAACGTGAGCATCAAGAAGCTGAAGCGGAAGCCTCCCTCCACAA

ACGCCGGCAGGAGGCAGAAGCACAGGCTGACCTGCCCCAGCTGTGACTCC

TACGAGAAGAAGCCCCCCAAGGAGTTCCTGGAGAGGTTCAAGTCCCTGCT

GCAGAAGATGATCCATCAGCACCTGTCCTCCAGGACCCACGGCTCCGAGG

ACTCC.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 302)
MKWVTFISLLFLFSSAYSIPPHVQKSVNNDMIVTDNNGAVKFPQLCKFCD

VRFSTCDNQKSCMSNCSITSICEKPQEVCVAVWRKNDENITLETVCHDPK

LPYHDFILEDAASPKCIMKEKKKPGETFFMCSCSSDECNDNIIFSEEYNT

SNPDGGGGSGGGGSGGGGSIPPHVQKSVNNDMIVTDNNGAVKFPQLCKFC

DVRFSTCDNQKSCMSNCSITSICEKPQEVCVAVWRKNDENITLETVCHDP

KLPYHDFILEDAASPKCIMKEKKKPGETFFMCSCSSDECNDNIIFSEEYN

TSNPDITCPPPMSVEHADIWVKSYSLYSRERYICNSGFKRKAGTSSLTEC

VLNKATNVAHWTTPSLKCIRQGQDRHMIRMRQLIDIVDQLKNYVNDLVPE

FLPAPEDVETNCEWSAFSCFQKAQLKSANTGNNERIINVSIKKLKRKPPS

TNAGRRQKHRLTCPSCDSYEKKPPKEFLERFKSLLQKMIHQHLSSRTHGS

EDS.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 303)
ATGAAGTGGGTGACCTTCATCAGCCTGCTGTTCCTGTTCTCCAGCGCCTA

CTCCATCCCCCCCCATGTGCAAAAGAGCGTGAACAACGATATGATCGTGA

CCGACAACAACGGCGCCGTGAAGTTTCCCCAGCTCTGCAAGTTCTGCGAT

GTCAGGTTCAGCACCTGCGATAATCAGAAGTCCTGCATGTCCAACTGCAG

CATCACCTCCATCTGCGAGAAGCCCCAAGAAGTGTGCGTGGCCGTGTGGC

GGAAAAATGACGAGAACATCACCCTGGAGACCGTGTGTCACGACCCCAAG

CTCCCTTATCACGACTTCATTCTGGAGGACGCTGCCTCCCCCAAATGCAT

CATGAAGGAGAAGAAGAAGCCCGGAGAGACCTTCTTTATGTGTTCCTGTA

GCAGCGACGAGTGTAACGACAACATCATCTTCAGCGAAGAGTACAACACC

AGCAACCCTGATGGAGGTGGCGGATCCGGAGGTGGAGGTTCTGGTGGAGG

TGGGAGTATTCCTCCCCACGTGCAGAAGAGCGTGAATAATGACATGATCG

TGACCGATAACAATGGCGCCGTGAAATTTCCCCAGCTGTGCAAATTCTGC

GATGTGAGGTTTTCCACCTGCGACAACCAGAAGTCCTGTATGAGCAACTG

CTCCATCACCTCCATCTGTGAGAAGCCTCAGGAGGTGTGCGTGGCTGTCT

GGCGGAAGAATGACGAGAATATCACCCTGGAAACCGTCTGCCACGATCCC

AAGCTGCCCTACCACGATTTCATCCTGGAAGACGCCGCCAGCCCTAAGTG

CATCATGAAAGAGAAAAGAAGCCTGGCGAGACCTTTTTCATGTGCTCCT

GCAGCAGCGACGAATGCAACGACAATATCATCTTTAGCGAGGAATACAAT

ACCAGCAACCCCGACATTACATGCCCCCCTCCCATGAGCGTGGAGCACGC

CGACATCTGGGTGAAGAGCTATAGCCTCTACAGCCGGGAGAGGTATATCT

GTAACAGCGGCTTCAAGAGGAAGGCCGGCACCAGCAGCCTCACCGAGTGC

GTGCTGAATAAGGCTACCAACGTGGCTCACTGGACAACACCCTCTTTAAA

GTGCATCCGGCAGGGCCAGGACAGGCACATGATCCGGATGAGGCAGCTCA

TCGACATCGTCGACCAGCTGAAGAACTACGTGAACGACCTGGTGCCCGAG

TTTCTGCCTGCCCCCGAGGACGTGGAGACCAACTGCGAGTGGTCCGCCTT

CTCCTGCTTTCAGAAGGCCCAGCTGAAGTCCGCCAACACCGGCAACAACG

AGCGGATCATCAACGTGAGCATCAAGAAGCTGAAGCGGAAGCCTCCCTCC

ACAAACGCCGGCAGGAGGCAGAAGCACAGGCTGACCTGCCCCAGCTGTGA

CTCCTACGAGAAGAAGCCCCCCAAGGAGTTCCTGGAGAGGTTCAAGTCCC

TGCTGCAGAAGATGATCCATCAGCACCTGTCCTCCAGGACCCACGGCTCC

GAGGACTCC.
```

Exemplary Multi-Chain Chimeric Polypeptides—Type N

In some embodiments of any of the multi-chain chimeric polypeptides described herein, the first target-binding domain and the second targeting-binding domain each independently bind specifically to TGF-β or CD16. In some embodiments of these multi-chain chimeric polypeptides described herein, the second chimeric polypeptide further includes the additional target-binding domain. In some embodiments of these multi-chain chimeric polypeptides described herein, the additional target-binding domain binds specifically to CD16 (e.g., an anti-CD16 scFv) or a TGF-β (e.g., a soluble TGF-β receptor, e.g., a soluble TGFβRII receptor).

In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments, the second chimeric polypeptide further comprises one or more additional target-binding domains at the N-terminal end or the C-terminal end of the second chimeric polypeptide.

In some embodiments of these multi-chain chimeric polypeptides, the additional target-binding domain and the second domain of the pair of affinity domains directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the additional target-binding domain in the second chimeric polypeptide.

In some embodiments of these multi-chain chimeric polypeptides, the additional target-binding domain and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second target-binding domain and the additional target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, the first target-binding domain binds specifically to TGF-β, and the second target-binding domain binds specifically to TGF-β or CD16. In some embodiments of these multi-chain chimeric polypeptides, the first target-binding domain is a soluble TGF-β receptor (e.g., a soluble TGFβRII receptor, e.g., a soluble human TGFβRII receptor). In some embodiments of these multi-chain chimeric polypeptides, the soluble human TGFRβRII includes a first sequence of soluble human TGFRβRII and a second sequence of soluble human TGFRβRII. In some embodiments of these multi-chain chimeric polypeptides, the soluble human TGFRβRII includes a linker disposed between the first sequence of soluble human TGFRβRII and the second sequence of soluble human TGFRβRII. In some examples of these multi-chain chimeric polypeptides, the linker includes the sequence GGGGSGGGGSGGGGS (SEQ ID NO: 102).

In some embodiments of these multi-chain chimeric polypeptides, the first sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 183)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the second sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 184)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD.

In some embodiments of these multi-chain chimeric polypeptides, the first sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 185)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGAT.

In some embodiments of these multi-chain chimeric polypeptides, the second sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 186)
ATTCCTCCCCACGTGCAGAAGAGCGTGAATAATGACATGATCGTGACCGA

TAACAATGGCGCCGTGAAATTTCCCCAGCTGTGCAAATTCTGCGATGTGA

GGTTTTCCACCTGCGACAACCAGAAGTCCTGTATGAGCAACTGCTCCATC

ACCTCCATCTGTGAGAAGCCTCAGGAGGTGTGCGTGGCTGTCTGGCGGAA

GAATGACGAGAATATCACCCTGGAAACCGTCTGCCACGATCCCAAGCTGC

CCTACCACGATTTCATCCTGGAAGACGCCGCCAGCCCTAAGTGCATCATG

AAAGAGAAAAAGAAGCCTGGCGAGACCTTTTTCATGTGCTCCTGCAGCAG

CGACGAATGCAACGACAATATCATCTTTAGCGAGGAATACAATACCAGCA

ACCCCGAC.

In some embodiments of these multi-chain chimeric polypeptides, the soluble TGF-β receptor includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 188)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD.

In some embodiments of these multi-chain chimeric polypeptides, the soluble TGF-β receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 187)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGAC.

In some embodiments of these multi-chain chimeric polypeptides, the second target-binding domain binds specifically to CD16. In some embodiments of these multi-chain chimeric polypeptides, the second target-binding domain includes an anti-CD16 scFv. In some embodiments of these multi-chain chimeric polypeptides, the scFv that binds specifically to CD16 includes a light chain variable domain that includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 215)
SELTQDPAVSVALGQTVRITCQGDSLRSYYASWYQQKPGQAPVLVIYGKN

NRPSGIPDRFSGSSSGNTASLTITGAQAEDEADYYCNSRDSSGNHVVFGG

GTKLTVGH.

In some embodiments of these multi-chain chimeric polypeptides, the scFv that binds specifically to CD16 is encoded by a light chain variable domain sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 216)
TCCGAGCTGACCCAGGACCCTGCTGTGTCCGTGGCTCTGGGCCAGACCGT

GAGGATCACCTGCCAGGGCGACTCCCTGAGGTCCTACTACGCCTCCTGGT

ACCAGCAGAAGCCCGGCCAGGCTCCTGTGCTGGTGATCTACGGCAAGAAC

AACAGGCCCTCCGGCATCCCTGACAGGTTCTCCGGATCCTCCTCCGGCAA

CACCGCCTCCCTGACCATCACAGGCGCTCAGGCCGAGGACGAGGCTGACT

ACTACTGCAACTCCAGGGACTCCTCCGGCAACCATGTGGTGTTCGGCGGC

GGCACCAAGCTGACCGTGGGCCAT.

In some embodiments of these multi-chain chimeric polypeptides, the scFv that binds specifically to CD16 includes a heavy chain variable domain that includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                         (SEQ ID NO: 217)
EVQLVESGGGVVRPGGSLRLSCAASGFTFDDYGMSWVRQAPGKGLEWVSG

INWNGGSTGYADSVKGRFTISRDNAKNSLYLQMNSLRAEDTAVYYCARGR

SLLFDYWGQGTLVTVSR.
```

In some embodiments of these multi-chain chimeric polypeptides, the scFv that binds specifically to CD16 is encoded by a heavy chain variable domain sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                         (SEQ ID NO: 218)
GAGGTGCAGCTGGTGGAGTCCGGAGGAGGAGTGGTGAGGCCTGGAGGCT

CCCTGAGGCTGAGCTGTGCTGCCTCCGGCTTCACCTTCGACGACTACGG

CATGTCCTGGGTGAGGCAGGCTCCTGGAAAGGGCCTGGAGTGGGTGTCC

GGCATCAACTGGAACGGCGGATCCACCGGCTACGCCGATTCCGTGAAGG

GCAGGTTCACCATCAGCAGGGACAACGCCAAGAACTCCCTGTACCTGCA

GATGAACTCCCTGAGGGCCGAGGACACCGCCGTGTACTACTGCGCCAGG

GGCAGGTCCCTGCTGTTCGACTACGGGGACAGGGCACCCTGGTGACCG

TGTCCAGG.
```

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                         (SEQ ID NO: 236)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPDGGGGSGGGGSG

GGGSIPPHVQKSVNNDMIVTDNNGAVKFPQLCKFCDVRFSTCDNQKSCM

SNCSITSICEKPQEVCVAVWRKNDENITLETVCHDPKLPYHDFILEDAA

SPKCIMKEKKKPGETFFMCSCSSDECNDNIIFSEEYNTSNPDSGTTNTV

AAYNLTWKSTNFKTILEWEPKPVNQVYTVQISTKSGDWKSKCFYTTDTE

CDLTDEIVKDVKQTYLARVFSYPAGNVESTGSAGEPLYENSPEFTPYLE

TNLGQPTIQSFEQVGTKVNVTVEDERTLVRRNNTFLSLRDVFGKDLIYT

LYYWKSSSSGKKTAKTNTNEFLIDVDKGENYCFSVQAVIPSRTVNRKST

DSPVECMGQEKGEFRENWVNVISDLKKIEDLIQSMHIDATLYTESDVHP
```

-continued
```
SCKVTAMKCFLLELQVISLESGDASIHDTVENLIILANNSLSSNGNVTE

SGCKECEELEEKNIKEFLQSFVHIVQMFINTS.
```

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                         (SEQ ID NO: 237)
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCAGC

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCCAAATGC

ATCATGAAGGAGAAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGATGGAGGTGGCGGATCCGGAGGTGGAGGTTCTGGT

GGAGGTGGGAGTATTCCTCCCCACGTGCAGAAGAGCGTGAATAATGACA

TGATCGTGACCGATAACAATGGCGCCGTGAAATTTCCCCAGCTGTGCAA

ATTCTGCGATGTGAGGTTTTCCACCTGCGACAACCAGAAGTCCTGTATG

AGCAACTGCTCCATCACCTCCATCTGTGAGAAGCCTCAGGAGGTGTGCG

TGGCTGTCTGGCGGAAGAATGACGAGAATATCACCCTGGAAACCGTCTG

CCACGATCCCAAGCTGCCCTACCACGATTTCATCCTGGAAGACGCCGCC

AGCCCTAAGTGCATCATGAAAGAGAAAAAGAAGCCTGGCGAGACCTTTT

TCATGTGCTCCTGCAGCAGCGACGAATGCAACGACAATATCATCTTTAG

CGAGGAATACAATACCAGCAACCCCGACAGCGGCACAACCAACACAGTC

GCTGCCTATAACCTCACTTGGAAGAGCACCAACTTCAAAACCATCCTCG

AATGGGAACCCAAACCCGTTAACCAAGTTTACACCGTGCAGATCAGCAC

CAAGTCCGGCGACTGGAAGTCCAAATGTTTCTATACCACCGACACCGAG

TGCGATCTCACCGATGAGATCGTGAAAGATGTGAAACAGACCTACCTCG

CCCGGGTGTTTAGCTACCCCGCCGGCAATGTGGAGAGCACTGGTTCCGC

TGGCGAGCCTTTATACGAGAACAGCCCCGAATTTACCCCTTACCTCGAG

ACCAATTTAGGACAGCCCACCATCCAAAGCTTTGAGCAAGTTGGCACAA

AGGTGAATGTGACAGTGGAGGACGAGCGGACTTTAGTGCGGCGGAACAA

CACCTTTCTCAGCCTCCGGGATGTGTTCGGCAAAGATTTAATCTACACA

CTGTATTACTGGAAGTCCTCTTCCTCCGGCAAGAAGACAGCTAAAACCA

ACACAAACGAGTTTTTAATCGACGTGGATAAAGGCGAAAACTACTGTTT

CAGCGTGCAAGCTGTGATCCCCTCCCGGACCGTGAATAGGAAAAGCACC

GATAGCCCCGTTGAGTGCATGGGCCAAGAAAAGGGCGAGTTCCGGGAGA

ACTGGGTGAACGTCATCAGCGATTTAAAGAAGATCGAAGATTTAATTCA
```

```
GTCCATGCATATCGACGCCACTTTATACACAGAATCCGACGTGCACCCC
TCTTGTAAGGTGACCGCCATGAAATGTTTTTTACTGGAGCTGCAAGTTA
TCTCTTTAGAGAGCGGAGACGCTAGCATCCACGACACCGTGGAGAATTT
AATCATTTTAGCCAATAACTCTTTATCCAGCAACGGCAACGTGACAGAG
TCCGGCTGCAAGGAGTGCGAAGAGCTGGAGGAGAAGAACATCAAGGAGT
TTCTGCAATCCTTTGTGCACATTGTCCAGATGTTCATCAATACCTCC.
```

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 238)
MKWVTFISLLFLFSSAYSIPPHVQKSVNNDMIVTDNNGAVKFPQLCKFC
DVRFSTCDNQKSCMSNCSITSICEKPQEVCVAVWRKNDENITLETVCHD
PKLPYHDFILEDAASPKCIMKEKKKPGETFFMCSCSSDECNDNIIFSEE
YNTSNPDGGGGSGGGGSGGGGSIPPHVQKSVNNDMIVTDNNGAVKFPQL
CKFCDVRFSTCDNQKSCMSNCSITSICEKPQEVCVAVWRKNDENITLET
VCHDPKLPYHDFILEDAASPKCIMKEKKKPGETFFMCSCSSDECNDNII
FSEEYNTSNPDSGTTNTVAAYNLTWKSTNFKTILEWEPKPVNQVYTVQI
STKSGDWKSKCFYTTDTECDLTDEIVKDVKQTYLARVFSYPAGNVESTG
SAGEPLYENSPEFTPYLETNLGQPTIQSFEQVGTKVNVTVEDERTLVRR
NNTFLSLRDVFGKDLIYTLYYWKSSSSGKKTAKTNTNEFLIDVDKGENY
CFSVQAVIPSRTVNRKSTDSPVECMGQEKGEFRENWVNVISDLKKIEDL
IQSMHIDATLYTESDVHPSCKVTAMKCFLLELQVISLESGDASIHDTVE
NLIILANNSLSSNGNVTESGCKECEELEEKNIKEFLQSFVHIVQMFINT
S.
```

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 239)
ATGAAGTGGGTGACCTTCATCAGCCTGCTGTTCCTGTTCTCCAGCGCCT
ACTCCATCCCCCCCCATGTGCAAAAGAGCGTGAACAACGATATGATCGT
GACCGACAACAACGGCGCCGTGAAGTTTCCCCAGCTCTGCAAGTTCTGC
GATGTCAGGTTCAGCACCTGCGATAATCAGAAGTCCTGCATGTCCAACT
GCAGCATCACCTCCATCTGCGAGAAGCCCCAAGAAGTGTGCGTGGCCGT
GTGGCGGAAAAATGACGAGAACATCACCCTGGAGACCGTGTGTCACGAC
CCCAAGCTCCCTTATCACGACTTCATTCTGGAGGACGCTGCCTCCCCCA
AATGCATCATGAAGGAGAAGAAGAAGCCCGGAGAGACCTTCTTTATGTG
TTCCTGTAGCAGCGACGAGTGTAACGACAACATCATCTTCAGCGAAGAG
TACAACACCAGCAACCCTGATGGAGGTGGCGGATCCGGAGGTGGAGGTT
CTGGTGGAGGTGGGAGTATTCCTCCCCACGTGCAGAAGAGCGTGAATAA
TGACATGATCGTGACCGATAACAATGGCGCCGTGAAATTTCCCCAGCTG
TGCAAATTCTGCGATGTGAGGTTTTCCACCTGCGACAACCAGAAGTCCT
GTATGAGCAACTGCTCCATCACCTCCATCTGTGAGAAGCCTCAGGAGGT
GTGCGTGGCTGTCTGGCGGAAGAATGACGAGAATATCACCCTGGAAACC
GTCTGCCACGATCCCAAGCTGCCCTACCACGATTTCATCCTGGAAGACG
CCGCCAGCCCTAAGTGCATCATGAAAGAGAAAAAGAAGCCTGGCGAGAC
CTTTTTCATGTGCTCCTGCAGCAGCGACGAATGCAACGACAATATCATC
TTTAGCGAGGAATACAATACCAGCAACCCCGACAGCGGCACAACCAACA
CAGTCGCTGCCTATAACCTCACTTGGAAGAGCACCAACTTCAAAACCAT
CCTCGAATGGGAACCCAAACCCGTTAACCAAGTTTACACCGTGCAGATC
AGCACCAAGTCCGGCGACTGGAAGTCCAAATGTTTCTATACCACCGACA
CCGAGTGCGATCTCACCGATGAGATCGTGAAAGATGTGAAACAGACCTA
CCTCGCCCGGGTGTTTAGCTACCCCGCCGGCAATGTGGAGAGCACTGGT
TCCGCTGGCGAGCCTTTATACGAGAACAGCCCCGAATTTACCCCTTACC
TCGAGACCAATTTAGGACAGCCCACCATCCAAAGCTTTGAGCAAGTTGG
CACAAAGGTGAATGTGACAGTGGAGGACGAGCGGACTTTAGTGCGGCGG
AACAACACCTTTCTCAGCCTCCGGGATGTGTTCGGCAAAGATTTAATCT
ACACACTGTATTACTGGAAGTCCTCTTCCTCCGGCAAGAAGACAGCTAA
AACCAACACAAACGAGTTTTTAATCGACGTGGATAAAGGCGAAAACTAC
TGTTTCAGCGTGCAAGCTGTGATCCCCTCCCGGACCGTGAATAGGAAAA
GCACCGATAGCCCCGTTGAGTGCATGGGCCAAGAAAAGGGCGAGTTCCG
GGAGAACTGGGTGAACGTCATCAGCGATTTAAAGAAGATCGAAGATTTA
ATTCAGTCCATGCATATCGACGCCACTTTATACACAGAATCCGACGTGC
ACCCCTCTTGTAAGGTGACCGCCATGAAATGTTTTTTACTGGAGCTGCA
AGTTATCTCTTTAGAGAGCGGAGACGCTAGCATCCACGACACCGTGGAG
AATTTAATCATTTTAGCCAATAACTCTTTATCCAGCAACGGCAACGTGA
CAGAGTCCGGCTGCAAGGAGTGCGAAGAGCTGGAGGAGAAGAACATCAA
GGAGTTTCTGCAATCCTTTGTGCACATTGTCCAGATGTTCATCAATACC
TCC.
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                      (SEQ ID NO: 308)
IPPHVQKSVNNDMIVTDNNGAVKFPQLCKFCDVRFSTCDNQKSCMSNCS
ITSICEKPQEVCVAVWRKNDENITLETVCHDPKLPYHDFILEDAASPKC
IMKEKKKPGETFFMCSCSSDECNDNIIFSEEYNTSNPDGGGGSGGGGSG
```

```
GGGSIPPHVQKSVNNDMIVTDNNGAVKFPQLCKFCDVRFSTCDNQKSCM

SNCSITSICEKPQEVCVAVWRKNDENITLETVCHDPKLPYHDFILEDAA

SPKCIMKEKKKPGETFFMCSCSSDECNDNIIFSEEYNTSNPDITCPPPM

SVEHADIWVKSYSLYSRERYICNSGFKRKAGTSSLTECVLNKATNVAHW

TTPSLKCIRSELTQDPAVSVALGQTVRITCQGDSLRSYYASWYQQKPGQ

APVLVIYGKNNRPSGIPDRFSGSSSGNTASLTITGAQAEDEADYYCNSR

DSSGNHVVFGGGTKLTVGHGGGGSGGGGSGGGGSEVQLVESGGGVVRPG

GSLRLSCAASGFTFDDYGMSWVRQAPGKGLEWVSGINWNGGSTGYADSV

KGRFTISRDNAKNSLYLQMNSLRAEDTAVYYCARGRSLLFDYWGQGTLV

TVSR.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                        (SEQ ID NO: 309)
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCAGC

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCCAAATGC

ATCATGAAGGAGAAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGATGGAGGTGGCGGATCCGGAGGTGGAGGTTCTGGT

GGAGGTGGGAGTATTCCTCCCCACGTGCAGAAGAGCGTGAATAATGACA

TGATCGTGACCGATAACAATGGCGCCGTGAAATTTCCCCAGCTGTGCAA

ATTCTGCGATGTGAGGTTTTCCACCTGCGACAACCAGAAGTCCTGTATG

AGCAACTGCTCCATCACCTCCATCTGTGAGAAGCCTCAGGAGGTGTGCG

TGGCTGTCTGGCGGAAGAATGACGAGAATATCACCCTGGAAACCGTCTG

CCACGATCCCAAGCTGCCCTACCACGATTTCATCCTGGAAGACGCCGCC

AGCCCTAAGTGCATCATGAAAGAGAAAAAGAAGCCTGGCGAGACCTTTT

TCATGTGCTCCTGCAGCAGCGACGAATGCAACGACAATATCATCTTTAG

CGAGGAATACAATACCAGCAACCCCGACATTACATGCCCCCCTCCCATG

AGCGTGGAGCACGCCGACATCTGGGTGAAGAGCTATAGCCTCTACAGCC

GGGAGAGGTATATCTGTAACAGCGGCTTCAAGAGGAAGGCCGGCACCAG

CAGCCTCACCGAGTGCGTGCTGAATAAGGCTACCAACGTGGCTCACTGG

ACAACACCCTCTTTAAAGTGCATCCGGTCCGAGCTGACCCAGGACCCTG

CTGTGTCCGTGGCTCTGGGCCAGACCGTGAGGATCACCTGCCAGGGCGA

CTCCCTGAGGTCCTACTACGCCTCCTGGTACCAGCAGAAGCCCGGCCAG

GCTCCTGTGCTGGTGATCTACGGCAAGAACAACAGGCCCTCCGGCATCC
```

```
CTGACAGGTTCTCCGGATCCTCCTCCGGCAACACCGCCTCCCTGACCAT

CACAGGCGCTCAGGCCGAGGACGAGGCTGACTACTACTGCAACTCCAGG

GACTCCTCCGGCAACCATGTGGTGTTCGGCGGCGGCACCAAGCTGACCG

TGGGCCATGGCGGCGGCGGCTCCGGAGGCGGCGGCAGCGGCGGAGGAGG

ATCCGAGGTGCAGCTGGTGGAGTCCGGAGGAGGAGTGGTGAGGCCTGGA

GGCTCCCTGAGGCTGAGCTGTGCTGCCTCCGGCTTCACCTTCGACGACT

ACGGCATGTCCTGGGTGAGGCAGGCTCCTGGAAAGGGCCTGGAGTGGGT

GTCCGGCATCAACTGGAACGGCGGATCCACCGGCTACGCCGATTCCGTG

AAGGGCAGGTTCACCATCAGCAGGGACAACGCCAAGAACTCCCTGTACC

TGCAGATGAACTCCCTGAGGGCCGAGGACACCGCCGTGTACTACTGCGC

CAGGGGCAGGTCCCTGCTGTTCGACTACGGGGACAGGGCACCCTGGTG

ACCGTGTCCAGG.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                        (SEQ ID NO: 310)
MKWVTFISLLFLFSSAYSIPPHVQKSVNNDMIVTDNNGAVKFPQLCKFC

DVRFSTCDNQKSCMSNCSITSICEKPQEVCVAVWRKNDENITLETVCHD

PKLPYHDFILEDAASPKCIMKEKKKPGETFFMCSCSSDECNDNIIFSEE

YNTSNPDGGGGSGGGGSGGGGSIPPHVQKSVNNDMIVTDNNGAVKFPQL

CKFCDVRFSTCDNQKSCMSNCSITSICEKPQEVCVAVWRKNDENITLET

VCHDPKLPYHDFILEDAASPKCIMKEKKKPGETFFMCSCSSDECNDNII

FSEEYNTSNPDITCPPPMSVEHADIWVKSYSLYSRERYICNSGFKRKAG

TSSLTECVLNKATNVAHWTTPSLKCIRSELTQDPAVSVALGQTVRITCQ

GDSLRSYYASWYQQKPGQAPVLVIYGKNNRPSGIPDRFSGSSSGNTASL

TITGAQAEDEADYYCNSRDSSGNHVVFGGGTKLTVGHGGGGSGGGGSGG

GGSEVQLVESGGGVVRPGGSLRLSCAASGFTFDDYGMSWVRQAPGKGLE

WVSGINWNGGSTGYADSVKGRFTISRDNAKNSLYLQMNSLRAEDTAVYY

CARGRSLLFDYWGQGTLVTVSR.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                        (SEQ ID NO: 311)
ATGAAGTGGGTGACCTTCATCAGCCTGCTGTTCCTGTTCTCCAGCGCCT

ACTCCATCCCCCCCCATGTGCAAAAGAGCGTGAACAACGATATGATCGT

GACCGACAACAACGGCGCCGTGAAGTTTCCCCAGCTCTGCAAGTTCTGC
```

```
-continued
GATGTCAGGTTCAGCACCTGCGATAATCAGAAGTCCTGCATGTCCAACT

GCAGCATCACCTCCATCTGCGAGAAGCCCCAAGAAGTGTGCGTGGCCGT

GTGGCGGAAAAATGACGAGAACATCACCCTGGAGACCGTGTGTCACGAC

CCCAAGCTCCCTTATCACGACTTCATTCTGGAGGACGCTGCCTCCCCA

AATGCATCATGAAGGAGAAGAAGAAGCCCGGAGAGACCTTCTTTATGTG

TTCCTGTAGCAGCGACGAGTGTAACGACAACATCATCTTCAGCGAAGAG

TACAACACCAGCAACCCTGATGGAGGTGGCGGATCCGGAGGTGGAGGTT

CTGGTGGAGGTGGGAGTATTCCTCCCCACGTGCAGAAGAGCGTGAATAA

TGACATGATCGTGACCGATAACAATGGCGCCGTGAAATTTCCCCAGCTG

TGCAAATTCTGCGATGTGAGGTTTTCCACCTGCGACAACCAGAAGTCCT

GTATGAGCAACTGCTCCATCACCTCCATCTGTGAGAAGCCTCAGGAGGT

GTGCGTGGCTGTCTGGCGGAAGAATGACGAGAATATCACCCTGGAAACC

GTCTGCCACGATCCCAAGCTGCCCTACCACGATTTCATCCTGGAAGACG

CCGCCAGCCCTAAGTGCATCATGAAAGAGAAAAAGAAGCCTGGCGAGAC

CTTTTTCATGTGCTCCTGCAGCAGCGACGAATGCAACGACAATATCATC

TTTAGCGAGGAATACAATACCAGCAACCCCGACATTACATGCCCCCCTC

CCATGAGCGTGGAGCACGCCGACATCTGGGTGAAGAGCTATAGCCTCTA

CAGCCGGGAGAGGTATATCTGTAACAGCGGCTTCAAGAGGAAGGCCGGC

ACCAGCAGCCTCACCGAGTGCGTGCTGAATAAGGCTACCAACGTGGCTC

ACTGGACAACACCCTCTTTAAAGTGCATCCGGTCCGAGCTGACCCAGGA

CCCTGCTGTGTCCGTGGCTCTGGGCCAGACCGTGAGGATCACCTGCCAG

GGCGACTCCCTGAGGTCCTACTACGCCTCCTGGTACCAGCAGAAGCCCG

GCCAGGCTCCTGTGCTGGTGATCTACGGCAAGAACAACAGGCCCTCCGG

CATCCCTGACAGGTTCTCCGGATCCTCCTCCGGCAACACCGCCTCCCTG

ACCATCACAGGCGCTCAGGCCGAGGACGAGGCTGACTACTACTGCAACT

CCAGGGACTCCTCCGGCAACCATGTGGTGTTCGGCGGCGGCACCAAGCT

GACCGTGGGCCATGGCGGCGGCGGCTCCGGAGGCGGCGGCAGCGGCGGA

GGAGGATCCGAGGTGCAGCTGGTGGAGTCCGGAGGAGGAGTGGTGAGGC

CTGGAGGCTCCCTGAGGCTGAGCTGTGCTGCCTCCGGCTTCACCTTCGA

CGACTACGGCATGTCCTGGGTGAGGCAGGCTCCTGGAAAGGGCCTGGAG

TGGGTGTCCGGCATCAACTGGAACGGCGGATCCACCGGCTACGCCGATT

CCGTGAAGGGCAGGTTCACCATCAGCAGGGACAACGCCAAGAACTCCCT

GTACCTGCAGATGAACTCCCTGAGGGCCGAGGACACCGCCGTGTACTAC

TGCGCCAGGGGCAGGTCCCTGCTGTTCGACTACTGGGGACAGGGCACCC

TGGTGACCGTGTCCAGG.
```

Exemplary Multi-Chain Chimeric Polypeptides—Type O

In some embodiments of any of the multi-chain chimeric polypeptides described herein, the first target-binding domain and the second targeting-binding domain each independently bind specifically to TGF-β or a receptor of CD137L. In some embodiments of these multi-chain chimeric polypeptides described herein, the second chimeric polypeptide further includes the additional target-binding domain. In some embodiments of these multi-chain chimeric polypeptides described herein, the additional target-binding domain binds specifically to a receptor to TGF-β (e.g., a soluble TGF-β receptor, e.g., a soluble TGFβRII receptor) or CD137L.

In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments, the second chimeric polypeptide further comprises one or more additional target-binding domains at the N-terminal end or the C-terminal end of the second chimeric polypeptide.

In some embodiments of these multi-chain chimeric polypeptides, the additional target-binding domain and the second domain of the pair of affinity domains directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the additional target-binding domain in the second chimeric polypeptide.

In some embodiments of these multi-chain chimeric polypeptides, the additional target-binding domain and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second target-binding domain and the additional target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, the first target-binding domain binds specifically to TGF-β, and the second target-binding domain binds specifically to CD137L. In some embodiments of these multi-chain chimeric polypeptides, the first target-binding domain or the additional target-binding domain is a soluble TGF-β receptor (e.g., a soluble TGFβRII receptor, e.g., a soluble human TGFβRII receptor).

In some embodiments of these multi-chain chimeric polypeptides, the soluble human TGFRβRII includes a first sequence of soluble human TGFRβRII and a second sequence of soluble human TGFRβRII. In some embodiments of these multi-chain chimeric polypeptides, the soluble human TGFRβRII includes a linker disposed between the first sequence of soluble human TGFRβRII and the second sequence of soluble human TGFRβRII. In some examples of these multi-chain chimeric polypeptides, the linker includes the sequence GGGGSGGGGSGGGGS (SEQ ID NO: 102).

In some embodiments of these multi-chain chimeric polypeptides, the first sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 183)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPD.

In some embodiments of these multi-chain chimeric polypeptides, the second sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 184)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPD

In some embodiments of these multi-chain chimeric polypeptides, the first sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 185)
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCAGC

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCCAAATGC

ATCATGAAGGAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGAT.

In some embodiments of these multi-chain chimeric polypeptides, the second sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 186)
ATTCCTCCCCACGTGCAGAAGAGCGTGAATAATGACATGATCGTGACCG

ATAACAATGGCGCCGTGAAATTTCCCCAGCTGTGCAAATTCTGCGATGT

GAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGC

GGAAGAATGACGAGAATATCACCCTGGAAACCGTCTGCCACGATCCCAA

GCTGCCCTACCACGATTTCATCCTGGAAGACGCCGCCAGCCCTAAGTGC

ATCATGAAAGAGAAAAAGAAGCCTGGCGAGACCTTTTTCATGTGCTCCT

GCAGCAGCGACGAATGCAACGACAATATCATCTTTAGCGAGGAATACAA

TACCAGCAACCCCGAC.

In some embodiments of these multi-chain chimeric polypeptides, the soluble TGF-β receptor includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 188)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPDGGGGSGGGGSG

GGGSIPPHVQKSVNNDMIVTDNNGAVKFPQLCKFCDVRFSTCDNQKSCM

SNCSITSICEKPQEVCVAVWRKNDENITLETVCHDPKLPYHDFILEDAA

SPKCIMKEKKKPGETFFMCSCSSDECNDNIIFSEEYNTSNPD.

In some embodiments of these multi-chain chimeric polypeptides, the soluble TGF-β receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 187)
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCAGC

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCCAAATGC

ATCATGAAGGAGAAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGATGGAGGTGGCGGATCCGGAGGTGGAGGTTCTGGT

GGAGGTGGGAGTATTCCTCCCCACGTGCAGAAGAGCGTGAATAATGACA

TGATCGTGACCGATAACAATGGCGCCGTGAAATTTCCCCAGCTGTGCAA

ATTCTGCGATGTGAGGTTTTCCACCTGCGACAACCAGAAGTCCTGTATG

AGCAACTGCTCCATCACCTCCATCTGTGAGAAGCCTCAGGAGGTGTGCG

TGGCTGTCTGGCGGAAGAATGACGAGAATATCACCCTGGAAACCGTCTG

CCACGATCCCAAGCTGCCCTACCACGATTTCATCCTGGAAGACGCCGCC

AGCCCTAAGTGCATCATGAAAGAGAAAAAGAAGCCTGGCGAGACCTTTT

TCATGTGCTCCTGCAGCAGCGACGAATGCAACGACAATATCATCTTTAG

CGAGGAATACAATACCAGCAACCCCGAC.

In some embodiments of these multi-chain chimeric polypeptides, the second target-binding domain includes a soluble CD137L protein (e.g., a soluble human CD137L protein). In some embodiments of these multi-chain chimeric polypeptides, a soluble human CD137L includes a sequence that is at least 80% identical (e.g., at least 85%, at least 90%, at least 95%, at least 96%, at least 97%, at least 98%, at least 99%, or 100% identical) to:

(SEQ ID NO: 260)
REGPELSPDDPAGLLDLRQGMFAQLVAQNVLLIDGPLSWYSDPGLAGVS

LTGGLSYKEDTKELVVAKAGVYYVFFQLELRRVVAGEGSGSVSLALHLQ

PLRSAAGAAALALTVDLPPASSEARNSAFGFQGRLLHLSAGQRLGVHLH

TEARARHAWQLTQGATVLGLFRVTPEIPAGLPSPRSE.

In some embodiments of these multi-chain chimeric polypeptides, a soluble human CD137L is encoded by a sequence that is at least 80% identical (e.g., at least 85%, at least 90%, at least 95%, at least 96%, at least 97%, at least 98%, at least 99%, or 100% identical) to:

(SEQ ID NO: 261)
CGCGAGGGTCCCGAGCTTTCGCCCGACGATCCCGCCGGCCTCTTGGACC

TGCGGCAGGGCATGTTTGCGCAGCTGGTGGCCCAAAATGTTCTGCTGAT

CGATGGGCCCCTGAGCTGGTACAGTGACCCAGGCCTGGCAGGCGTGTCC

CTGACGGGGGGCCTGAGCTACAAAGAGGACACGAAGGAGCTGGTGGTGG

CCAAGGCTGGAGTCTACTATGTCTTCTTTCAACTAGAGCTGCGGCGCGT

GGTGGCCGGCGAGGGCTCAGGCTCCGTTTCACTTGCGCTGCACCTGCAG

CCACTGCGCTCTGCTGCTGGGGCCGCCGCCCTGGCTTTGACCGTGGACC

TGCCACCCGCCTCCTCCGAGGCTCGGAACTCGGCCTTCGGTTTCCAGGG

CCGCTTGCTGCACCTGAGTGCCGGCCAGCGCCTGGGCGTCCATCTTCAC

ACTGAGGCCAGGGCACGCCATGCCTGGCAGCTTACCCAGGGCGCCACAG

TCTTGGGACTCTTCCGGGTGACCCCCGAAATCCCAGCCGGACTCCCTTC

ACCGAGGTCGGAA.

In some embodiments of these multi-chain chimeric polypeptides, a soluble human CD137L includes a sequence that is at least 80% identical (e.g., at least 85%, at least 90%, at least 95%, at least 96%, at least 97%, at least 98%, at least 99%, or 100% identical) to:

(SEQ ID NO: 262)
DPAGLLDLRQGMFAQLVAQNVLLIDGPLSWYSDPGLAGVSLTGGLSYKE

DTKELVVAKAGVYYVFFQLELRRVVAGEGSGSVSLALHLQPLRSAAGAA

ALALTVDLPPASSEARNSAFGFQGRLLHLSAGQRLGVHLHTEARARHAW

QLTQGATVLGLFRVTPEI.

In some embodiments of these multi-chain chimeric polypeptides, a soluble human CD137L is encoded by a sequence that is at least 80% identical (e.g., at least 85%, at least 90%, at least 95%, at least 96%, at least 97%, at least 98%, at least 99%, or 100% identical) to:

(SEQ ID NO: 263)
GATCCCGCCGGCCTCTTGGACCTGCGGCAGGGCATGTTTGCGCAGCTGG

TGGCCCAAAATGTTCTGCTGATCGATGGGCCCCTGAGCTGGTACAGTGA

CCCAGGCCTGGCAGGCGTGTCCCTGACGGGGGGCCTGAGCTACAAAGAG

GACACGAAGGAGCTGGTGGTGGCCAAGGCTGGAGTCTACTATGTCTTCT

TTCAACTAGAGCTGCGGCGCGTGGTGGCCGGCGAGGGCTCAGGCTCCGT

TTCACTTGCGCTGCACCTGCAGCCACTGCGCTCTGCTGCTGGGGCCGCC

GCCCTGGCTTTGACCGTGGACCTGCCACCCGCCTCCTCCGAGGCTCGGA

ACTCGGCCTTCGGTTTCCAGGGCCGCTTGCTGCACCTGAGTGCCGGCCA

GCGCCTGGGCGTCCATCTTCACACTGAGGCCAGGGCACGCCATGCCTGG

CAGCTTACCCAGGGCGCCACAGTCTTGGGACTCTTCCGGGTGACCCCCG

AAATC.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 236)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPDGGGGSGGGGSG

GGGSIPPHVQKSVNNDMIVTDNNGAVKFPQLCKFCDVRFSTCDNQKSCM

SNCSITSICEKPQEVCVAVWRKNDENITLETVCHDPKLPYHDFILEDAA

SPKCIMKEKKKPGETFFMCSCSSDECNDNIIFSEEYNTSNPDSGTTNTV

AAYNLTWKSTNFKTILEWEPKPVNQVYTVQISTKSGDWKSKCFYTTDTE

CDLTDEIVKDVKQTYLARVFSYPAGNVESTGSAGEPLYENSPEFTPYLE

-continued

TNLGQPTIQSFEQVGTKVNVTVEDERTLVRRNNTFLSLRDVFGKDLIYT

LYYWKSSSSGKKTAKTNTNEFLIDVDKGENYCFSVQAVIPSRTVNRKST

DSPVECMGQEKGEFRENWVNVISDLKKIEDLIQSMHIDATLYTESDVHP

SCKVTAMKCFLLELQVISLESGDASIHDTVENLIILANNSLSSNGNVTE

SGCKECEELEEKNIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 237)
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCAGC

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCCAAATGC

ATCATGAAGGAGAAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGATGGAGGTGGCGGATCCGGAGGTGGAGGTTCTGGT

GGAGGTGGGAGTATTCCTCCCCACGTGCAAGAGCGTGAATAATGACA

TGATCGTGACCGATAACAATGGCGCCGTGAAATTTCCCCAGCTGTGCAA

ATTCTGCGATGTGAGGTTTTCCACCTGCGACAACCAGAAGTCCTGTATG

AGCAACTGCTCCATCACCTCCATCTGTGAGAAGCCTCAGGAGGTGTGCG

TGGCTGTCTGGCGGAAGAATGACGAGAATATCACCCTGGAAACCGTCTG

CCACGATCCCAAGCTGCCCTACCACGATTTCATCCTGGAAGACGCCGCC

AGCCCTAAGTGCATCATGAAAGAGAAAAAGAAGCCTGGCGAGACCTTTT

TCATGTGCTCCTGCAGCAGCGACGAATGCAACGACAATATCATCTTTAG

CGAGGAATACAATACCAGCAACCCCGACAGCGGCACAACCAACACAGTC

GCTGCCTATAACCTCACTTGGAAGAGCACCAACTTCAAAACCATCCTCG

AATGGGAACCCAAACCCGTTAACCAAGTTTACACCGTGCAGATCAGCAC

CAAGTCCGGCGACTGGAAGTCCAAATGTTTCTATACCACCGACACCGAG

TGCGATCTCACCGATGAGATCGTGAAAGATGTGAAACAGACCTACCTCG

CCCGGGTGTTTAGCTACCCCGCCGGCAATGTGGAGAGCACTGGTTCCGC

TGGCGAGCCTTTATACGAGAACAGCCCCGAATTTACCCCTTACCTCGAG

ACCAATTTAGGACAGCCCACCATCCAAAGCTTTGAGCAAGTTGGCACAA

AGGTGAATGTGACAGTGGAGGACGAGCGGACTTTAGTGCGGCGGAACAA

CACCTTTCTCAGCCTCCGGGATGTGTTCGGCAAAGATTTAATCTACACA

CTGTATTACTGGAAGTCCTCTTCCTCCGGCAAGAAGACAGCTAAACCA

ACACAAACGAGTTTTTAATCGACGTGGATAAAGGCGAAAACTACTGTTT

CAGCGTGCAAGCTGTGATCCCCTCCCGGACCGTGAATAGGAAAAGCACC

GATAGCCCCGTTGAGTGCATGGGCCAAGAAAAGGGCGAGTTCCGGGAGA

ACTGGGTGAACGTCATCAGCGATTTAAAGAAGATCGAAGATTTAATTCA

GTCCATGCATATCGACGCCACTTTATACACAGAATCCGACGTGCACCCC

TCTTGTAAGGTGACCGCCATGAAATGTTTTTTACTGGAGCTGCAAGTTA

TCTCTTTAGAGAGCGGAGACGCTAGCATCCACGACACCGTGGAGAATTT

AATCATTTTAGCCAATAACTCTTTATCCAGCAACGGCAACGTGACAGAG

TCCGGCTGCAAGGAGTGCGAAGAGCTGGAGGAGAAGAACATCAAGGAGT

TTCTGCAATCCTTTGTGCACATTGTCCAGATGTTCATCAATACCTCC.

In some embodiments, a first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 238)
MKWVTFISLLFLFSSAYSIPPHVQKSVNNDMIVTDNNGAVKFPQLCKFC

DVRFSTCDNQKSCMSNCSITSICEKPQEVCVAVWRKNDENITLETVCHD

PKLPYHDFILEDAASPKCIMKEKKKPGETFFMCSCSSDECNDNIIFSEE

YNTSNPDGGGGSGGGGSGGGGSIPPHVQKSVNNDMIVTDNNGAVKFPQL

CKFCDVRFSTCDNQKSCMSNCSITSICEKPQEVCVAVWRKNDENITLET

VCHDPKLPYHDFILEDAASPKCIMKEKKKPGETFFMCSCSSDECNDNII

FSEEYNTSNPDSGTTNTVAAYNLTWKSTNFKTILEWEPKPVNQVYTVQI

STKSGDWKSKCFYTTDTECDLTDEIVKDVKQTYLARVFSYPAGNVESTG

SAGEPLYENSPEFTPYLETNLGQPTIQSFEQVGTKVNVTVEDERTLVRR

NNTFLSLRDVFGKDLIYTLYYWKSSSSGKKTAKTNTNEFLIDVDKGENY

CFSVQAVIPSRTVNRKSTDSPVECMGQEKGEFRENWVNVISDLKKIEDL

IQSMHIDATLYTESDVHPSCKVTAMKCFLLELQVISLESGDASIHDTVE

NLIILANNSLSSNGNVTESGCKECEELEEKNIKEFLQSFVHIVQMFINT

S.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 239)
ATGAAGTGGGTGACCTTCATCAGCCTGCTGTTCCTGTTCTCCAGCGCCT

ACTCCATCCCCCCCATGTGCAAAAGAGCGTGAACAACGATATGATCGT

GACCGACAACAACGGCGCCGTGAAGTTTCCCCAGCTCTGCAAGTTCTGC

GATGTCAGGTTCAGCACCTGCGATAATCAGAAGTCCTGCATGTCCAACT

GCAGCATCACCTCCATCTGCGAGAAGCCCCAAGAAGTGTGCGTGGCCGT

GTGGCGGAAAAATGACGAGAACATCACCCTGGAGACCGTGTGTCACGAC

-continued

```
CCCAAGCTCCCTTATCACGACTTCATTCTGGAGGACGCTGCCTCCCCA

AATGCATCATGAAGGAGAAGAAGAAGCCCGGAGAGACCTTCTTTATGTG

TTCCTGTAGCAGCGACGAGTGTAACGACAACATCATCTTCAGCGAAGAG

TACAACACCAGCAACCCTGATGGAGGTGGCGGATCCGGAGGTGGAGGTT

CTGGTGGAGGTGGGAGTATTCCTCCCCACGTGCAGAAGAGCGTGAATAA

TGACATGATCGTGACCGATAACAATGGCGCCGTGAAATTTCCCCAGCTG

TGCAAATTCTGCGATGTGAGGTTTTCCACCTGCGACAACCAGAAGTCCT

GTATGAGCAACTGCTCCATCACCTCCATCTGTGAGAAGCCTCAGGAGGT

GTGCGTGGCTGTCTGGCGGAAGAATGACGAGAATATCACCCTGGAAACC

GTCTGCCACGATCCCAAGCTGCCCTACCACGATTTCATCCTGGAAGACG

CCGCCAGCCCTAAGTGCATCATGAAAGAGAAAAAGAAGCCTGGCGAGAC

CTTTTTCATGTGCTCCTGCAGCAGCGACGAATGCAACGACAATATCATC

TTTAGCGAGGAATACAATACCAGCAACCCCGACAGCGGCACAACCAACA

CAGTCGCTGCCTATAACCTCACTTGGAAGAGCACCAACTTCAAAACCAT

CCTCGAATGGGAACCCAAACCCGTTAACCAAGTTTACACCGTGCAGATC

AGCACCAAGTCCGGCGACTGGAAGTCCAAATGTTTCTATACCACCGACA

CCGAGTGCGATCTCACCGATGAGATCGTGAAAGATGTGAAACAGACCTA

CCTCGCCCGGGTGTTTAGCTACCCCGCCGGCAATGTGGAGAGCACTGGT

TCCGCTGGCGAGCCTTTATACGAGAACAGCCCCGAATTTACCCCTTACC

TCGAGACCAATTTAGGACAGCCCACCATCCAAAGCTTTGAGCAAGTTGG

CACAAAGGTGAATGTGACAGTGGAGGACGAGCGGACTTTAGTGCGGCGG

AACAACACCTTTCTCAGCCTCCGGGATGTGTTCGGCAAAGATTTAATCT

ACACACTGTATTACTGGAAGTCCTCTTCCTCCGGCAAGAAGACAGCTAA

AACCAACACAAACGAGTTTTTAATCGACGTGGATAAAGGCGAAAACTAC

TGTTTCAGCGTGCAAGCTGTGATCCCCTCCCGGACCGTGAATAGGAAAA

GCACCGATAGCCCCGTTGAGTGCATGGGCCAAGAAAAGGGCGAGTTCCG

GGAGAACTGGGTGAACGTCATCAGCGATTTAAAGAAGATCGAAGATTTA

ATTCAGTCCATGCATATCGACGCCACTTTATACACAGAATCCGACGTGC

ACCCCTCTTGTAAGGTGACCGCCATGAAATGTTTTTACTGGAGCTGCA

AGTTATCTCTTTAGAGAGCGGAGACGCTAGCATCCACGACACCGTGGAG

AATTTAATCATTTTAGCCAATAACTCTTTATCCAGCAACGGCAACGTGA

CAGAGTCCGGCTGCAAGGAGTGCGAAGAGCTGGAGGAGAAGAACATCAA

GGAGTTTCTGCAATCCTTTGTGCACATTGTCCAGATGTTCATCAATACC

TCC.
```

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 316)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPDGGGGSGGGGSG

GGGSIPPHVQKSVNNDMIVTDNNGAVKFPQLCKFCDVRFSTCDNQKSCM

SNCSITSICEKPQEVCVAVWRKNDENITLETVCHDPKLPYHDFILEDAA

SPKCIMKEKKKPGETFFMCSCSSDECNDNIIFSEEYNTSNPDITCPPPM

SVEHADIWVKSYSLYSRERYICNSGFKRKAGTSSLTECVLNKATNVAHW

TTPSLKCIRGGGGSGGGGSGGGGSREGPELSPDDPAGLLDLRQGMFAQL

VAQNVLLIDGPLSWYSDPGLAGVSLTGGLSYKEDTKELVVAKAGVYYVF

FQLELRRVVAGEGSGSVSLALHLQPLRSAAGAAALALTVDLPPASSEAR

NSAFGFQGRLLHLSAGQRLGVHLHTEARARHAWQLTQGATVLGLFRVTP

EIPAGLPSPRSE.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 317)
```
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCAGC

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCAAATGC

ATCATGAAGGAGAAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGATGGAGGTGGCGGATCCGGAGGTGGAGGTTCTGGT

GGAGGTGGGAGTATTCCTCCCCACGTGCAGAAGAGCGTGAATAATGACA

TGATCGTGACCGATAACAATGGCGCCGTGAAATTTCCCCAGCTGTGCAA

ATTCTGCGATGTGAGGTTTTCCACCTGCGACAACCAGAAGTCCTGTATG

AGCAACTGCTCCATCACCTCCATCTGTGAGAAGCCTCAGGAGGTGTGCG

TGGCTGTCTGGCGGAAGAATGACGAGAATATCACCCTGGAAACCGTCTG

CCACGATCCCAAGCTGCCCTACCACGATTTCATCCTGGAAGACGCCGCC

AGCCCTAAGTGCATCATGAAAGAGAAAAAGAAGCCTGGCGAGACCTTTT

TCATGTGCTCCTGCAGCAGCGACGAATGCAACGACAATATCATCTTTAG

CGAGGAATACAATACCAGCAACCCCGACATTACATGCCCCCCTCCCATG

AGCGTGGAGCACGCCGACATCTGGGTGAAGAGCTATAGCCTCTACAGCC

GGGAGAGGTATATCTGTAACAGCGGCTTCAAGAGGAAGGCCGGCACCAG

CAGCCTCACCGAGTGCGTGCTGAATAAGGCTACCAACGTGGCTCACTGG

ACAACACCCTCTTTAAAGTGCATCCGGGGCGGTGGAGGATCCGGAGGAG
```

```
GTGGCTCCGGCGGCGGAGGATCTCGCGAGGGTCCCGAGCTTTCGCCCGA

CGATCCCGCCGGCCTCTTGGACCTGCGGCAGGGCATGTTTGCGCAGCTG

GTGGCCCAAAATGTTCTGCTGATCGATGGGCCCCTGAGCTGGTACAGTG

ACCCAGGCCTGGCAGGCGTGTCCCTGACGGGGGGCCTGAGCTACAAAGA

GGACACGAAGGAGCTGGTGGTGGCCAAGGCTGGAGTCTACTATGTCTTC

TTTCAACTAGAGCTGCGGCGCGTGGTGGCCGGCGAGGGCTCAGGCTCCG

TTTCACTTGCGCTGCACCTGCAGCCACTGCGCTCTGCTGCTGGGGCCGC

CGCCCTGGCTTTGACCGTGGACCTGCCACCCGCCTCCTCCGAGGCTCGG

AACTCGGCCTTCGGTTTCCAGGGCCGCTTGCTGCACCTGAGTGCCGGCC

AGCGCCTGGGCGTCCATCTTCACACTGAGGCCAGGGCACGCCATGCCTG

GCAGCTTACCCAGGGCGCCACAGTCTTGGGACTCTTCCGGGTGACCCCC

GAAATCCCAGCCGGACTCCCTTCACCGAGGTCGGAA.
```

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                          (SEQ ID NO: 318)
MKWVTFISLLFLFSSAYSIPPHVQKSVNNDMIVTDNNGAVKFPQLCKFC

DVRFSTCDNQKSCMSNCSITSICEKPQEVCVAVWRKNDENITLETVCHD

PKLPYHDFILEDAASPKCIMKEKKKPGETFFMCSCSSDECNDNIIFSEE

YNTSNPDGGGGSGGGGSGGGGSIPPHVQKSVNNDMIVTDNNGAVKFPQL

CKFCDVRFSTCDNQKSCMSNCSITSICEKPQEVCVAVWRKNDENITLET

VCHDPKLPYHDFILEDAASPKCIMKEKKKPGETFFMCSCSSDECNDNII

FSEEYNTSNPDITCPPPMSVEHADIWVKSYSLYSRERYICNSGFKRKAG

TSSLTECVLNKATNVAHWTTPSLKCIRGGGGSGGGGSGGGGSREGPELS

PDDPAGLLDLRQGMFAQLVAQNVLLIDGPLSWYSDPGLAGVSLTGGLSY

KEDTKELVVAKAGVYYVFFQLELRRVVAGEGSGSVSLALHLQPLRSAAG

AAALALTVDLPPASSEARNSAFGFQGRLLHLSAGQRLGVHLHTEARARH

AWQLTQGATVLGLFRVTPEIPAGLPSPRSE.
```

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

```
                                          (SEQ ID NO: 319)
ATGAAGTGGGTGACCTTCATCAGCCTGCTGTTCCTGTTCTCCAGCGCCT

ACTCCATCCCCCCCCATGTGCAAAAGAGCGTGAACAACGATATGATCGT

GACCGACAACAACGGCGCCGTGAAGTTTCCCCAGCTCTGCAAGTTCTGC

GATGTCAGGTTCAGCACCTGCGATAATCAGAAGTCCTGCATGTCCAACT

GCAGCATCACCTCCATCTGCGAGAAGCCCCAAGAAGTGTGCGTGGCCGT

GTGGCGGAAAAATGACGAGAACATCACCCTGGAGACCGTGTGTCACGAC

CCCAAGCTCCCTTATCACGACTTCATTCTGGAGGACGCTGCCTCCCCCA

AATGCATCATGAAGGAGAAGAAGAAGCCCGGAGAGACCTTCTTTATGTG

TTCCTGTAGCAGCGACGAGTGTAACGACAACATCATCTTCAGCGAAGAG

TACAACACCAGCAACCCTGATGGAGGTGGCGGATCCGGAGGTGGAGGTT

CTGGTGGAGGTGGGAGTATTCCTCCCCACGTGCAGAAGAGCGTGAATAA

TGACATGATCGTGACCGATAACAATGGCGCCGTGAAATTTCCCCAGCTG

TGCAAATTCTGCGATGTGAGGTTTTCCACCTGCGACAACCAGAAGTCCT

GTATGAGCAACTGCTCCATCACCTCCATCTGTGAGAAGCCTCAGGAGGT

GTGCGTGGCTGTCTGGCGGAAGAATGACGAGAATATCACCCTGGAAACC

GTCTGCCACGATCCCAAGCTGCCCTACCACGATTTCATCCTGGAAGACG

CCGCCAGCCCTAAGTGCATCATGAAAGAGAAAAAGAAGCCTGGCGAGAC

CTTTTTCATGTGCTCCTGCAGCAGCGACGAATGCAACGACAATATCATC

TTTAGCGAGGAATACAATACCAGCAACCCCGACATTACATGCCCCCCTC

CCATGAGCGTGGAGCACGCCGACATCTGGGTGAAGAGCTATAGCCTCTA

CAGCCGGGAGAGGTATATCTGTAACAGCGGCTTCAAGAGGAAGGCCGGC

ACCAGCAGCCTCACCGAGTGCGTGCTGAATAAGGCTACCAACGTGGCTC

ACTGGACAACACCCTCTTTAAAGTGCATCCGGGCGGTGGAGGATCCGG

AGGAGGTGGCTCCGGCGGCGGAGGATCTCGCGAGGGTCCCGAGCTTTCG

CCCGACGATCCCGCCGGCCTCTTGGACCTGCGGCAGGGCATGTTTGCGC

AGCTGGTGGCCCAAAATGTTCTGCTGATCGATGGGCCCCTGAGCTGGTA

CAGTGACCCAGGCCTGGCAGGCGTGTCCCTGACGGGGGGCCTGAGCTAC

AAAGAGGACACGAAGGAGCTGGTGGTGGCCAAGGCTGGAGTCTACTATG

TCTTCTTTCAACTAGAGCTGCGGCGCGTGGTGGCCGGCGAGGGCTCAGG

CTCCGTTTCACTTGCGCTGCACCTGCAGCCACTGCGCTCTGCTGCTGGG

GCCGCCGCCCTGGCTTTGACCGTGGACCTGCCACCCGCCTCCTCCGAGG

CTCGGAACTCGGCCTTCGGTTTCCAGGGCCGCTTGCTGCACCTGAGTGC

CGGCCAGCGCCTGGGCGTCCATCTTCACACTGAGGCCAGGGCACGCCAT

GCCTGGCAGCTTACCCAGGGCGCCACAGTCTTGGGACTCTTCCGGGTGA

CCCCCGAAATCCCAGCCGGACTCCCTTCACCGAGGTCGGAA.
```

Exemplary Multi-Chain Chimeric Polypeptides—Type P

In some embodiments of any of the multi-chain chimeric polypeptides described herein, the first target-binding domain and the second targeting-binding domain each bind specifically to TGF-β. In some embodiments of these multi-chain chimeric polypeptides described herein, the first chimeric polypeptide further includes the additional target-binding domain. A non-limiting example of this type of multi-chain chimeric polypeptide is shown in FIGS. 209 and 210.

In some examples of these multi-chain chimeric polypeptides, the first target-binding domain and the soluble tissue factor domain directly abut each other in the first chimeric polypeptide. In some examples of these multi-chain chimeric polypeptides, the first chimeric polypeptide further comprises a linker sequence (e.g., any of the exemplary linkers described herein) between the first target-binding domain and the soluble tissue factor domain in the first chimeric polypeptide.

In some embodiments of these multi-chain chimeric polypeptides, the soluble tissue factor domain and the first domain of the pair of affinity domains directly abut each other in the first chimeric polypeptide. In some embodiments of these multi-chain chimeric polypeptides, the first chimeric polypeptide further includes a linker sequence (e.g., any of the exemplary linkers described herein) between the soluble tissue factor domain and the first domain of the pair of affinity domains in the first chimeric polypeptide.

In some embodiments of these multi-chain chimeric polypeptides, the second domain of the pair of affinity domains and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the second target-binding domain in the second chimeric polypeptide.

In some embodiments, the second chimeric polypeptide further comprises one or more additional target-binding domains at the N-terminal end or the C-terminal end of the second chimeric polypeptide.

In some embodiments of these multi-chain chimeric polypeptides, the additional target-binding domain and the second domain of the pair of affinity domains directly abut each other in the second chimeric polypeptide. In some embodiments of these multi-chain chimeric polypeptides, the second chimeric polypeptide further includes a linker sequence (e.g., any of the exemplary linkers described herein) between the second domain of the pair of affinity domains and the additional target-binding domain in the second chimeric polypeptide.

In some embodiments of these multi-chain chimeric polypeptides, the additional target-binding domain and the second target-binding domain directly abut each other in the second chimeric polypeptide. In some embodiments of these multi-chain chimeric polypeptides, the second chimeric polypeptide further includes a linker sequence (e.g., any of the exemplary linkers described herein) between the second target-binding domain and the additional target-binding domain in the second chimeric polypeptide.

In some embodiments of these multi-chain chimeric polypeptides, the soluble tissue factor domain can be any of the exemplary soluble tissue factor domains described herein. In some embodiments of these multi-chain chimeric polypeptides, the pair of affinity domains can be any of the exemplary pairs of affinity domains described herein.

In some embodiments of these multi-chain chimeric polypeptides, the first target-binding domain binds specifically to TGF-β, and the second target-binding domain binds specifically to TGF-β. In some embodiments of these multi-chain chimeric polypeptides, the first target-binding domain and/or the second target-binding domain is a soluble TGF-β receptor (e.g., a soluble TGFβRII receptor, e.g., a soluble human TGFβRII receptor).

In some embodiments of these multi-chain chimeric polypeptides, the soluble human TGFRβRII includes a first sequence of soluble human TGFRβRII and a second sequence of soluble human TGFRβRII. In some embodiments of these multi-chain chimeric polypeptides, the soluble human TGFRβRII includes a linker disposed between the first sequence of soluble human TGFRβRII and the second sequence of soluble human TGFRβRII. In some examples of these multi-chain chimeric polypeptides, the linker includes the sequence GGGGSGGGGSGGGGS (SEQ ID NO: 102).

In some embodiments of these multi-chain chimeric polypeptides, the first sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 183)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPD.

In some embodiments of these multi-chain chimeric polypeptides, the second sequence of soluble human TGFRβRII receptor comprises a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 184)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPD.

In some embodiments of these multi-chain chimeric polypeptides, the first sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 185)
ATCCCCCCCCATGTGCAAAAGAGCGTGAACAACGATATGATCGTGACCG

ACAACAACGGCGCCGTGAAGTTTCCCCAGCTCTGCAAGTTCTGCGATGT

CAGGTTCAGCACCTGCGATAATCAGAAGTCCTGCATGTCCAACTGCAGC

ATCACCTCCATCTGCGAGAAGCCCCAAGAAGTGTGCGTGGCCGTGTGGC

GGAAAAATGACGAGAACATCACCCTGGAGACCGTGTGTCACGACCCCAA

GCTCCCTTATCACGACTTCATTCTGGAGGACGCTGCCTCCCCCAAATGC

ATCATGAAGGAGAAGAAGAAGCCCGGAGAGACCTTCTTTATGTGTTCCT

GTAGCAGCGACGAGTGTAACGACAACATCATCTTCAGCGAAGAGTACAA

CACCAGCAACCCTGAT.

In some embodiments of these multi-chain chimeric polypeptides, the second sequence of soluble human TGFRβRII receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 186)
ATTCCTCCCCACGTGCAGAAGAGCGTGAATAATGACATGATCGTGACCGA

TAACAATGGCGCCGTGAAATTTCCCCAGCTGTGCAAATTCTGCGATGTGA

GGTTTTCCACCTGCGACAACCAGAAGTCCTGTATGAGCAACTGCTCCATC

ACCTCCATCTGTGAGAAGCCTCAGGAGGTGTGCGTGGCTGTCTGGCGGAA

GAATGACGAGAATATCACCCTGGAAACCGTCTGCCACGATCCCAAGCTGC

CCTACCACGATTTCATCCTGGAAGACGCCGCCAGCCCTAAGTGCATCATG

AAAGAGAAAAAGAAGCCTGGCGAGACCTTTTTCATGTGCTCCTGCAGCAG

CGACGAATGCAACGACAATATCATCTTTAGCGAGGAATACAATACCAGCA

ACCCCGAC.

In some embodiments of these multi-chain chimeric polypeptides, the soluble TGF-β receptor includes a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 188)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD.

In some embodiments of these multi-chain chimeric polypeptides, the soluble TGF-β receptor is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 187)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGAC.

In some embodiments, the first chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 238)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPDSGTTNTVAAYNLT

WKSTNFKTILEWEPKPVNQVYTVQISTKSGDWKSKCFYTTDTECDLTDEI

VKDVKQTYLARVFSYPAGNVESTGSAGEPLYENSPEFTPYLETNLGQPTI

QSFEQVGTKVNVTVEDERTLVRRNNTFLSLRDVFGKDLIYTLYYWKSSSS

GKKTAKTNTNEFLIDVDKGENYCFSVQAVIPSRTVNRKSTDSPVECMGQE

KGEFRENWVNVISNLKKIEDLIQSMHIDATLYTESDVHPSCKVTAMKCFL

LELQVISLESGDASIHDTVENLIILANNSLSSNGNVTESGCKECEELEEK

NIKEFLQSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 239)
ATCCCACCGCACGTTCAGAAGTCGGTGAATAACGACATGATAGTCACTGA

CAACAACGGTGCAGTCAAGTTTCCACAACTGTGTAAATTTTGTGATGTGA

GATTTTCCACCTGTGACAACCAGAAATCCTGCATGAGCAACTGCAGCATC

ACCTCCATCTGTGAGAAGCCACAGGAAGTCTGTGTGGCTGTATGGAGAAA

GAATGACGAGAACATAACACTAGAGACAGTTTGCCATGACCCCAAGCTCC

CCTACCATGACTTTATTCTGGAAGATGCTGCTTCTCCAAAGTGCATTATG

AAGGAAAAAAAAAAGCCTGGTGAGACTTTCTTCATGTGTTCCTGTAGCTC

TGATGAGTGCAATGACAACATCATCTTCTCAGAAGAATATAACACCAGCA

-continued

ATCCTGACGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGACTCAGGCACTACAAATACTGTGGCAGCATATAATTTAACT

TGGAAATCAACTAATTTCAAGACAATTTTGGAGTGGGAACCCAAACCCGT

CAATCAAGTCTACACTGTTCAAATAAGCACTAAGTCAGGAGATTGGAAAA

GCAAATGCTTTTACACAACAGACACAGAGTGTGACCTCACCGACGAGATT

GTGAAGGATGTGAAGCAGACGTACTTGGCACGGGTCTTCTCCTACCCGGC

AGGGAATGTGGAGAGCACCGGTTCTGCTGGGGAGCCTCTGTATGAGAACT

CCCCAGAGTTCACACCTTACCTGGAGACAAACCTCGGACAGCCAACAATT

CAGAGTTTTGAACAGGTGGGAACAAAAGTGAATGTGACCGTAGAAGATGA

ACGGACTTTAGTCAGAAGGAACAACACTTTCCTAAGCCTCCGGGATGTTT

TTGGCAAGGACTTAATTTATACACTTTATTATTGGAAATCTTCAAGTTCA

GGAAAGAAAACAGCCAAAACAAACACTAATGAGTTTTTGATTGATGTGGA

TAAAGGAGAAAACTACTGTTTCAGTGTTCAAGCAGTGATTCCCTCCCGAA

CAGTTAACCGGAAGAGTACAGACAGCCCGGTAGAGTGTATGGGCCAGGAG

AAAGGGGAATTCAGAGAAAACTGGGTGAATGTAATAAGTAATTTGAAAAA

AATTGAAGATCTTATTCAATCTATGCATATTGATGCTACTTTATATACGG

AAAGTGATGTTCACCCCAGTTGCAAAGTAACAGCAATGAAGTGCTTTCTC

TTGGAGTTACAAGTTATTTCACTTGAGTCCGGAGATGCAAGTATTCATGA

TACAGTAGAAAATCTGATCATCCTAGCAAACAACAGTTTGTCTTCTAATG

GGAATGTAACAGAATCTGGATGCAAAGAATGTGAGGAACTGGAGGAAAAA

AATATTAAAGAATTTTTGCAGAGTTTTGTACATATTGTCCAAATGTTCAT

CAACACTTCT.

In some embodiments, a first chimeric polypeptide can include a soluble IL-15 including a D8N amino acid substitution and have a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(Signal peptide)
MGVKVLFALICIAVAEA (Single chain Human TGF-beta Receptor II homodimer)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

-continued

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD (Tissue factor)
SGTTNTVAAYNLTWKSTNFKTILEWEPKPVNQVYTVQISTKSGDWKSKCF

YTTDTECDLTDEIVKDVKQTYLARVFSYPAGNVESTGSAGEPLYENSPEF

TPYLETNLGQPTIQSFEQVGTKVNVTVEDERTLVRRNNTFLSLRDVFGKD

LIYTLYYWKSSSSGKKTAKTNTNEFLIDVDKGENYCFSVQAVIPSRTVNR

KSTDSPVECMGQEKGEFRE (IL-15D8N)
(SEQ ID NO: 238)
NWVNVISNLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS.

In some embodiments, a first chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(Signal peptide)
ATGGGAGTGAAAGTTCTTTTTGCCCTTATTTGTATTGCTGTGGCCGAGGC

C (Single chain Human TGF-beta Receptor II homodimer)
ATCCCACCGCACGTTCAGAAGTCGGTGAATAACGACATGATAGTCACTGA

CAACAACGGTGCAGTCAAGTTTCCACAACTGTGTAAATTTTGTGATGTGA

GATTTTCCACCTGTGACAACCAGAAATCCTGCATGAGCAACTGCAGCATC

ACCTCCATCTGTGAGAAGCCACAGGAAGTCTGTGTGGCTGTATGGAGAAA

GAATGACGAGAACATAACACTAGAGACAGTTTGCCATGACCCCAAGCTCC

CCTACCATGACTTTATTCTGGAAGATGCTGCTTCTCCAAAGTGCATTATG

AAGGAAAAAAAAAAGCCTGGTGAGACTTTCTTCATGTGTTCCTGTAGCTC

TGATGAGTGCAATGACAACATCATCTTCTCAGAAGAATATAACACCAGCA

ATCCTGACGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGAC (Human Tissue Factor 219)
TCAGGCACTACAAATACTGTGGCAGCATATAATTTAACTTGGAAATCAAC

TAATTTCAAGACAATTTTGGAGTGGGAACCCAAACCCGTCAATCAAGTCT

ACACTGTTCAAATAAGCACTAAGTCAGGAGATTGGAAAAGCAAATGCTTT

TACACAACAGACACAGAGTGTGACCTCACCGACGAGATTGTGAAGGATGT

GAAGCAGACGTACTTGGCACGGGTCTTCTCCTACCCGGCAGGGAATGTGG

AGAGCACCGGTTCTGCTGGGGAGCCTCTGTATGAGAACTCCCCAGAGTTC

ACACCTTACCTGGAGACAAACCTCGGACAGCCAACAATTCAGAGTTTTGA

ACAGGTGGGAACAAAAGTGAATGTGACCGTAGAAGATGAACGGACTTTAG

TCAGAAGGAACAACACTTTCCTAAGCCTCCGGGATGTTTTTGGCAAGGAC

TTAATTTATACACTTTATTATTGGAAATCTTCAAGTTCAGGAAAGAAAAC

AGCCAAAACAAACACTAATGAGTTTTTGATTGATGTGGATAAAGGAGAAA

ACTACTGTTTCAGTGTTCAAGCAGTGATTCCCTCCCGAACAGTTAACCGG

AAGAGTACAGACAGCCCGGTAGAGTGTATGGGCCAGGAGAAAGGGGAATT

CAGAGAA (Human IL-15D8N)
(SEQ ID NO: 244)
AACTGGGTGAATGTAATAAGTAATTTGAAAAAAATTGAAGATCTTATTCA

ATCTATGCATATTGATGCTACTTTATATACGGAAAGTGATGTTCACCCCA

GTTGCAAAGTAACAGCAATGAAGTGCTTTCTCTTGGAGTTACAAGTTATT

TCACTTGAGTCCGGAGATGCAAGTATTCATGATACAGTAGAAAATCTGAT

CATCCTAGCAAACAACAGTTTGTCTTCTAATGGGAATGTAACAGAATCTG

GATGCAAAGAATGTGAGGAACTGGAGGAAAAAAATATTAAAGAATTTTTG

CAGAGTTTTGTACATATTGTCCAAATGTTCATCAACACTTCT.

In some embodiments, the second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 240)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPDITCPPPMSVEHAD

IWVKSYSLYSRERYICNSGFKRKAGTSSLTECVLNKATNVAHWTTPSLKC

IR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 241)
ATCCCCCCCCATGTGCAAAAGAGCGTGAACAACGATATGATCGTGACCGA

CAACAACGGCGCCGTGAAGTTTCCCCAGCTCTGCAAGTTCTGCGATGTCA

GGTTCAGCACCTGCGATAATCAGAAGTCCTGCATGTCCAACTGCAGCATC

ACCTCCATCTGCGAGAAGCCCCAAGAAGTGTGCGTGGCCGTGTGGCGGAA

AAATGACGAGAACATCACCCTGGAGACCGTGTGTCACGACCCCAAGCTCC

CTTATCACGACTTCATTCTGGAGGACGCTGCCTCCCCCAAATGCATCATG

AAGGAGAAGAAGAAGCCCGGAGAGACCTTCTTTATGTGTTCCTGTAGCAG

CGACGAGTGTAACGACAACATCATCTTCAGCGAAGAGTACAACACCAGCA

ACCCTGATGGAGGTGGCGGATCCGGAGGTGGAGGTTCTGGTGGAGGTGGG

AGTATTCCTCCCCACGTGCAGAAGAGCGTGAATAATGACATGATCGTGAC

CGATAACAATGGCGCCGTGAAATTTCCCCAGCTGTGCAAATTCTGCGATG

TGAGGTTTTCCACCTGCGACAACCAGAAGTCCTGTATGAGCAACTGCTCC

ATCACCTCCATCTGTGAGAAGCCTCAGGAGGTGTGCGTGGCTGTCTGGCG

GAAGAATGACGAGAATATCACCCTGGAAACCGTCTGCCACGATCCCAAGC

TGCCCTACCACGATTTCATCCTGGAAGACGCCGCCAGCCCTAAGTGCATC

ATGAAAGAGAAAAAGAAGCCTGGCGAGACCTTTTTCATGTGCTCCTGCAG

CAGCGACGAATGCAACGACAATATCATCTTTAGCGAGGAATACAATACCA

GCAACCCCGACATTACATGCCCCCCTCCCATGAGCGTGGAGCACGCCGAC

ATCTGGGTGAAGAGCTATAGCCTCTACAGCCGGGAGAGGTATATCTGTAA

CAGCGGCTTCAAGAGGAAGGCCGGCACCAGCAGCCTCACCGAGTGCGTGC

TGAATAAGGCTACCAACGTGGCTCACTGGACAACACCCTCTTTAAAGTGC

ATCCGG.

In some embodiments, a second chimeric polypeptide can include a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 242)
MKWVTFISLLFLFSSAYSIPPHVQKSVNNDMIVTDNNGAVKFPQLCKFCD

VRFSTCDNQKSCMSNCSITSICEKPQEVCVAVWRKNDENITLETVCHDPK

LPYHDFILEDAASPKCIMKEKKKPGETFFMCSCSSDECNDNIIFSEEYNT

SNPDGGGGSGGGGSGGGGSIPPHVQKSVNNDMIVTDNNGAVKFPQLCKFC

DVRFSTCDNQKSCMSNCSITSICEKPQEVCVAVWRKNDENITLETVCHDP

KLPYHDFILEDAASPKCIMKEKKKPGETFFMCSCSSDECNDNIIFSEEYN

TSNPDITCPPPMSVEHADIWVKSYSLYSRERYICNSGFKRKAGTSSLTEC

VLNKATNVAHWTTPSLKCIR.

In some embodiments, a second chimeric polypeptide is encoded by a sequence that is at least 80% identical (e.g., at least 82% identical, at least 84% identical, at least 86% identical, at least 88% identical, at least 90% identical, at least 92% identical, at least 94% identical, at least 96% identical, at least 98% identical, at least 99% identical, or 100% identical) to:

(SEQ ID NO: 243)
ATGAAGTGGGTGACCTTCATCAGCCTGCTGTTCCTGTTCTCCAGCGCCTA

CTCCATCCCCCCCATGTGCAAAAGAGCGTGAACAACGATATGATCGTGA

CCGACAACAACGGCGCCGTGAAGTTTCCCCAGCTCTGCAAGTTCTGCGAT

GTCAGGTTCAGCACCTGCGATAATCAGAAGTCCTGCATGTCCAACTGCAG

CATCACCTCCATCTGCGAGAAGCCCCAAGAAGTGTGCGTGGCCGTGTGGC

GGAAAAATGACGAGAACATCACCCTGGAGACCGTGTGTCACGACCCCAAG

CTCCCTTATCACGACTTCATTCTGGAGGACGCTGCCTCCCCCAAATGCAT

CATGAAGGAGAAGAAGAAGCCCGGAGAGACCTTCTTTATGTGTTCCTGTA

GCAGCGACGAGTGTAACGACAACATCATCTTCAGCGAAGAGTACAACACC

AGCAACCCTGATGGAGGTGGCGGATCCGGAGGTGGAGGTTCTGGTGGAGG

TGGGAGTATTCCTCCCCACGTGCAGAAGAGCGTGAATAATGACATGATCG

TGACCGATAACAATGGCGCCGTGAAATTTCCCCAGCTGTGCAAATTCTGC

GATGTGAGGTTTTCCACCTGCGACAACCAGAAGTCCTGTATGAGCAACTG

CTCCATCACCTCCATCTGTGAGAAGCCTCAGGAGGTGTGCGTGGCTGTCT

GGCGGAAGAATGACGAGAATATCACCCTGGAAACCGTCTGCCACGATCCC

AAGCTGCCCTACCACGATTTCATCCTGGAAGACGCCGCCAGCCCTAAGTG

CATCATGAAAGAGAAAAAGAAGCCTGGCGAGACCTTTTTCATGTGCTCCT

GCAGCAGCGACGAATGCAACGACAATATCATCTTTAGCGAGGAATACAAT

ACCAGCAACCCCGACATTACATGCCCCCCTCCCATGAGCGTGGAGCACGC

CGACATCTGGGTGAAGAGCTATAGCCTCTACAGCCGGGAGAGGTATATCT

GTAACAGCGGCTTCAAGAGGAAGGCCGGCACCAGCAGCCTCACCGAGTGC

GTGCTGAATAAGGCTACCAACGTGGCTCACTGGACAACACCCTCTTTAAA

GTGCATCCGG.

Methods of Treating an Aging-Related Disease or Condition

Provided herein are methods of treating an aging-related disease or condition (e.g. any of the exemplary types of aging-related disease or condition described herein or known in the art) in a subject in need thereof that include administering to a subject identified as having an aging-related disease or condition (e.g. any of the exemplary types of aging-related disease or condition described herein or known in the art) a therapeutically effective amount of one or more natural killer (NK) cell activating agent(s) (e.g. any of the natural killer (NK) cell activating agent(s) described herein or known in the art).

Provided herein are methods of treating an aging-related disease or condition (e.g. any of the exemplary types of aging-related disease or condition described herein or known in the art) in a subject in need thereof that include administering to a subject identified as having an aging-related disease or condition (e.g. any of the exemplary types of aging-related disease or condition described herein or known in the art) a therapeutically effective amount of activated NK cells (e.g. any of the activated NK cells described herein or known in the art).

Some embodiments of these methods further include: obtaining a resting NK cell; and contacting the resting NK cell in vitro in a liquid culture medium including one or more NK cell activating agent(s), where the contacting results in the generation of the activated NK cells that are subsequently administered to the subject. In some examples of these methods, the resting NK cell is an autologous NK cell obtained from the subject. In some examples of these methods, the resting NK cell is a haploidentical NK cell obtained from the subject. In some examples of these methods, the resting NK cell is an allogeneic resting NK cell. In some examples of these methods, the resting NK cell is an artificial NK cell. In some examples of any of these methods, the resting NK cell is a genetically-engineered NK cell carrying a chimeric antigen receptor or recombinant T cell receptor.

In some examples of these methods, the liquid culture medium is a serum-free liquid culture medium. In some embodiments of any of the methods described herein, the liquid culture medium is a chemically-defined liquid culture medium. Some examples of these methods further include isolating the activated NK cells (and optionally further administering a therapeutically effective amount of the activated NK cells to a subject, e.g., any of the subjects described herein). In some embodiments of these methods, the contacting step is performed for a period of about 2 hours to about 20 days (or any of the subranges of this range described herein).

In some embodiments of any of the methods described herein, the aging-related disease or condition is selected from the group of: a cancer, an autoimmune disease, a metabolic disease, a neurodegenerative disease, a cardiovascular disease, a skin disease, a progeria disease, and a fragility disease.

Non-limiting examples of cancer include: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, B-cell lymphoma, B-cell non-Hodgkin's lymphoma, Hodgkin's lymphoma, chronic lymphocytic leukemia (CLL), acute myeloid leukemia (AML), chronic myeloid leukemia (CML), acute lymphocytic leukemia (ALL), myelodysplastic syndromes (MDS), cutaneous T-cell lymphoma, retinoblastoma, stomach cancer, urothelial carcinoma, lung cancer, renal cell carcinoma, gastric and esophageal cancer, pancreatic cancer, prostate cancer, breast cancer, colorectal cancer, ovarian cancer, non-small cell lung carcinoma, squamous cell head and neck carcinoma, endometrial cancer, cervical cancer, liver cancer, and hepatocellular carcinoma.

A non-limiting example of an autoimmune disease is type-1 diabetes.

Non-limiting examples of metabolic disease include: obesity, a lipodystrophy, and type-2 diabetes mellitus.

Non-limiting examples of neurodegenerative disease include: Alzheimer's disease, Parkinson's disease, and dementia.

Non-limiting examples of cardiovascular disease include: coronary artery disease, atherosclerosis, and pulmonary arterial hypertension.

Non-limiting examples of skin disease include: wound healing, alopecia, wrinkles, senile lentigo, skin thinning, xeroderma pigmentosum, and dyskeratosis congenita.

Non-limiting examples of progeria disease include: progeria and Hutchinson-Gilford Progeria Syndrome.

Non-limiting examples of fragility disease include: frailty, responsiveness to vaccination, osteoporosis, and sarcopenia.

In some embodiments of any of the aging-related disease or condition described herein, the aging-related disease or condition is selected from the group of: age-related macular degeneration, osteoarthritis, adipose atrophy, chronic obstructive pulmonary disease, idiopathic pulmonary fibrosis, kidney transplant failure, liver fibrosis, loss of bone mass, sarcopenia, age-associated loss of lung tissue elasticity, osteoporosis, age-associated renal dysfunction, and chemical-induced renal dysfunction.

In some embodiments of any of the aging-related disease or condition described herein, the aging-related disease or condition is type-2 diabetes or atherosclerosis.

In some embodiments of any of the methods described herein, the subject has been diagnosed or identified as having an aging-related disease or condition (e.g., any of the exemplary aging-related diseases or conditions described herein). Some embodiments of any of the methods described herein can include a step of selecting a subject identified or diagnosed as having an aging-related disease or condition (e.g., any of the exemplary aging-related diseases or conditions described herein).

In some embodiments of these methods, the administering results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 10% decrease to about a 99% decrease, about a 10% decrease to about a 95% decrease, about a 10% decrease to about a 90% decrease, about a 10% decrease to about a 85% decrease, about a 10% decrease to about a 80% decrease, about a 10% decrease to about a 75% decrease, about a 10% decrease to about a 70% decrease, about a 10% decrease to about a 65% decrease, about a 10% decrease to about a 60% decrease, about a 10% decrease to about a 55% decrease, about a 10% decrease to about a 50% decrease, about a 10% decrease to about a 45% decrease, about a 10% decrease to about a 40% decrease, about a 10% decrease to about a 35% decrease, about a 10% decrease to about a 30% decrease, about a 10% decrease to about a 25% decrease, about a 10% decrease to about a 20% decrease, about a 10% decrease to about a 15% decrease, about a 15% decrease to about a 99% decrease, about a 15% decrease to about a 95% decrease, about a 15% decrease to about a 90% decrease, about a 15% decrease to about a 85% decrease, about a 15% decrease to about a 80% decrease, about a 15% decrease to about a 75% decrease, about a 15% decrease to about a 70% decrease, about a 15% decrease to about a 65% decrease, about a 15% decrease to about a 60% decrease, about a 15% decrease to about a 55% decrease, about a 15% decrease to about a 50% decrease, about a 15% decrease to about a 45% decrease, about a 15% decrease to about a 40% decrease, about a 15% decrease to about a 35% decrease, about a 15% decrease to about a 30% decrease, about a 15% decrease to about a 25% decrease, about a 15% decrease to about a 20% decrease, about a 20% decrease to about a 99% decrease, about a 20% decrease to about a 95% decrease, about a 20% decrease to about a 90% decrease, about a 20% decrease to about a 85% decrease, about a 20% decrease to about a 80% decrease, about a 20% decrease to about a 75% decrease, about a 20% decrease to about a 70% decrease, about a 20% decrease to about a 65% decrease, about a 20% decrease to about a 60% decrease, about a 20% decrease to about a 55% decrease, about a 20% decrease to about a 50% decrease, about a 20% decrease to about a 45% decrease, about a 20% decrease to about a 40% decrease, about a 20% decrease to about a 35% decrease, about a 20% decrease to about a 30% decrease, about a 20% decrease to about a 25% decrease, about a 25% decrease to about a 99% decrease, about a 25% decrease to about a 95% decrease, about a 25% decrease to about a 90% decrease, about a 25% decrease to about a 85% decrease, about a 25% decrease to about a 80% decrease, about a 25% decrease to about a 75% decrease, about a 25% decrease to about a 70% decrease, about a 25% decrease to about a 65% decrease, about a 25% decrease to about a 60% decrease, about a 25% decrease to about a 55% decrease, about a 25% decrease to about a 50% decrease, about a 25% decrease to about a 45% decrease, about a 25% decrease to about a 40% decrease, about a 25% decrease to about a 35% decrease, about a 25% decrease to about a 30% decrease, about a 30% decrease to about a 99% decrease, about a 30% decrease to about a 95% decrease, about a 30% decrease to about a 90% decrease, about a 30% decrease to about a 85% decrease, about a 30% decrease to about a 80% decrease, about a 30% decrease to about a 75% decrease, about a 30% decrease to about a 70% decrease, about a 30% decrease to about a 65% decrease, about a 30% decrease to about a 60% decrease, about a 30% decrease to about a 55% decrease, about a 30% decrease to about a 50% decrease, about a 30% decrease to about a 45% decrease, about a 30% decrease to about a 40% decrease, about a 30% decrease to about a 35% decrease, about a 35% decrease to about a 99% decrease, about a 35% decrease to about a 95% decrease, about a 35% decrease to about a 90% decrease, about a 35% decrease to about a 85% decrease, about a 35% decrease to about a 80% decrease, about a 35% decrease to about a 75% decrease, about a 35% decrease to about a 70% decrease, about a 35% decrease to about a 65% decrease, about a 35% decrease to about a 60% decrease, about a 35% decrease to about a 55% decrease, about a 35% decrease to about a 50% decrease, about a 35% decrease to about a 45% decrease, about a 35% decrease to about a 40% decrease, about a 40% decrease to about a 99% decrease, about a 40% decrease to about a 95% decrease, about a 40% decrease to about a 90% decrease, about a 40% decrease to about a 85% decrease, about a 40% decrease to about a 80% decrease, about a 40% decrease to about a 75% decrease, about a 40% decrease to about a 70% decrease, about a 40% decrease to about a 65% decrease, about a 40% decrease to about a 60% decrease, about a 40% decrease to about a 55% decrease, about a 40% decrease to about a 50% decrease, about a 40% decrease to about a 45% decrease, about a 45% decrease to about a 99% decrease, about a 45% decrease to about a 95% decrease, about a 45% decrease to about a 90% decrease, about a 45% decrease to about a 85% decrease, about a 45% decrease to about a 80% decrease, about a 45% decrease to about a 75% decrease, about a 45% decrease to about a 70% decrease, about a 45% decrease to about a 65% decrease, about a 45% decrease to about a 60% decrease, about a 45% decrease to about a 55% decrease, about a 45% decrease to about a 50% decrease, about a 50% decrease to about a 99% decrease, about a 50% decrease to about a 95% decrease, about a 50% decrease to about a 90% decrease, about a 50% decrease to about a 85% decrease, about a 50% decrease to about a 80% decrease, about a 50% decrease to about a 75% decrease, about a 50% decrease to about a 70% decrease, about a 50% decrease to about a 65% decrease, about a 50% decrease to about a 60% decrease, about a 50% decrease to about a 55% decrease, about a 55% decrease to about a 99% decrease, about a 55% decrease to about a 95% decrease, about a 55% decrease to about a 90% decrease, about a 55% decrease to about a 85% decrease, about a 55% decrease to about a 80% decrease, about a 55% decrease to about a 75% decrease, about a 55% decrease to about a 70% decrease, about a 55% decrease to about a 65% decrease, about a 55% decrease to about a 60% decrease, about a 60% decrease to about a 99% decrease, about a 60% decrease to about a 95% decrease, about a 60% decrease to about a 90% decrease, about a 60% decrease to about a 85% decrease, about a 60% decrease to about a 80% decrease, about a 60% decrease to about a 75% decrease, about a 60% decrease to about a 70% decrease, about a 60% decrease to about a 65% decrease, about a 65% decrease to about a 99% decrease, about a 65% decrease to about a 95% decrease, about a 65% decrease to about a 90% decrease, about a 65% decrease to about a 85% decrease, about a 65% decrease to about a 80% decrease, about a 65% decrease to about a 75% decrease, about a 65% decrease to about a 70% decrease, about a 70% decrease to about a 99% decrease, about a 70% decrease to about a 95% decrease, about a 70% decrease to about a 90% decrease, about a 70% decrease to about a 85% decrease, about a 70% decrease to about a 80% decrease, about a 70% decrease to about a 75% decrease, about a 75% decrease to about a 99% decrease, about a 75% decrease to about a 95% decrease, about a 75% decrease to about a 90% decrease, about a 75% decrease to about a 85% decrease, about a 75% decrease to about a 80% decrease, about a 80% decrease to about a 99% decrease, about a 80% decrease to about a 95% decrease, about a 80% decrease to about a 90% decrease, about a 80% decrease to about a 85% decrease, about a 85% decrease to about a 99% decrease, about a 85% decrease to about a 95% decrease, about a 85% decrease to about a 90% decrease, about a 90% decrease to about a 99% decrease, about a 90% decrease to about a 95% decrease, or about a 95% decrease to about a 99% decrease) in the number of senescent cells in a target tissue in the subject, e.g., as compared to the number of senescent cells in the target tissue in the subject prior to treatment.

In some embodiments of these methods, the administering results in an increase (e.g., at least a 5% increase, at least a 10% increase, at least a 15% increase, at least a 20% increase, at least a 25% increase, at least a 30% increase, at least a 35% increase, at least a 40% increase, at least a 45% increase, at least a 50% increase, at least a 55% increase, at least a 60% increase, at least a 65% increase, at least a 70% increase, at least a 75% increase, at least a 80% increase, at least a 85% increase, at least a 90% increase, at least a 95% increase, or at least a 99% increase, or about a 10% increase to about a 500% increase (or any of the subranges of this range described herein) in the levels of IFN-γ, a cytotoxic granule granzyme, and/or perforin in the subject, as compared to the levels in a subject prior to treatment or a similar control subject who has not received a treatment.

In some embodiments, these methods can result in a reduction in the number, severity, or frequency of one or more symptoms of the cancer in the subject (e.g., as compared to the number, severity, or frequency of the one or more symptoms of the cancer in the subject prior to treatment). In some embodiments, these methods can result in a reduction (e.g., about 1% reduction to about 99% reduction, about 1% reduction to about 95% reduction, about 1% reduction to about 90% reduction, about 1% reduction to about 85% reduction, about 1% reduction to about 80% reduction, about 1% reduction to about 75% reduction, about 1% reduction to about 70% reduction, about 1% reduction to about 65% reduction, about 1% reduction to about 60% reduction, about 1% reduction to about 55% reduction, about 1% reduction to about 50% reduction, about 1% reduction to about 45% reduction, about 1% reduction to about 40% reduction, about 1% reduction to about 35% reduction, about 1% reduction to about 30% reduction, about 1% reduction to about 25% reduction, about 1% reduction to about 20% reduction, about 1% reduction to about 15% reduction, about 1% reduction to about 10% reduction, about 1% reduction to about 5% reduction, about 5% reduction to about 99% reduction, about 5% reduction to about 95% reduction, about 5% reduction to about 90% reduction, about 5% reduction to about 85% reduction, about 5% reduction to about 80% reduction, about 5% reduction to about 75% reduction, about 5% reduction to about 70% reduction, about 5% reduction to about 65% reduction, about 5% reduction to about 60% reduction, about 5% reduction to about 55% reduction, about 5% reduction to about 50% reduction, about 5% reduction to about 45% reduction, about 5% reduction to about 40% reduction, about 5% reduction to about 35% reduction, about 5% reduction to about 30% reduction, about 5% reduction to about 25% reduction, about 5% reduction to about 20% reduction, about 5% reduction to about 15% reduction, about 5% reduction to about 10% reduction, about 10% reduction to about 99% reduction, about 10% reduction to about 95% reduction, about 10% reduction to about 90% reduction, about 10% reduction to about 85% reduction, about 10% reduction to about 80% reduction, about 10% reduction to about 75% reduction, about 10% reduction to about 70% reduction, about 10% reduction to about 65% reduction, about 10% reduction to about 60% reduction, about 10% reduction to about 55% reduction, about 10% reduction to about 50% reduction, about 10% reduction to about 45% reduction, about 10% reduction to about 40% reduction, about 10% reduction to about 35% reduction, about 10% reduction to about 30% reduction, about 10% reduction to about 25% reduction, about 10% reduction to about 20% reduction, about 10% reduction to about 15% reduction, about 15% reduction to about 99% reduction, about 15% reduction to about 95% reduction, about 15% reduction to about 90% reduction, about 15% reduction to about 85% reduction, about 15% reduction to about 80% reduction, about 15% reduction to about 75% reduction, about 15% reduction to about 70% reduction, about 15% reduction to about 65% reduction, about 15% reduction to about 60% reduction, about 15% reduction to about 55% reduction, about 15% reduction to about 50% reduction, about 15% reduction to about 45% reduction, about 15% reduction to about 40% reduction, about 15% reduction to about 35% reduction, about 15% reduction to about 30% reduction, about 15% reduction to about 25% reduction, about 15% reduction to about 20% reduction, about 20% reduction to about 99% reduction, about 20% reduction to about 95% reduction, about 20% reduction to about 90% reduction, about 20% reduction to about 85% reduction, about 20% reduction to about 80% reduction, about 20% reduction to about 75% reduction, about 20% reduction to about 70% reduction, about 20% reduction to about 65% reduction, about 20% reduction to about 60% reduction, about 20% reduction to about 55% reduction, about 20% reduction to about 50% reduction, about 20% reduction to about 45% reduction, about 20% reduction to about 40% reduction, about 20% reduction to about 35% reduction, about 20% reduction to about 30% reduction, about 20% reduction to about 25% reduction, about 25% reduction to about 99% reduction, about 25% reduction to about 95% reduction, about 25% reduction to about 90% reduction, about 25% reduction to about 85% reduction, about 25% reduction to about 80% reduction, about 25% reduction to about 75% reduction, about 25% reduction to about 70% reduction, about 25% reduction to about 65% reduction, about 25% reduction to about 60% reduction, about 25% reduction to about 55% reduction, about 25% reduction to about 50% reduction, about 25% reduction to about 45% reduction, about 25% reduction to about 40% reduction, about 25% reduction to about 35% reduction, about 25% reduction to about 30% reduction, about 30% reduction to about 99% reduction, about 30% reduction to about 95% reduction, about 30% reduction to about 90% reduction, about 30% reduction to about 85% reduction, about 30% reduction to about 80% reduction, about 30% reduction to about 75% reduction, about 30% reduction to about 70% reduction, about 30% reduction to about 65% reduction, about 30% reduction to about 60% reduction, about 30% reduction to about 55% reduction, about 30% reduction to about 50% reduction, about 30% reduction to about 45% reduction, about 30% reduction to about 40% reduction, about 30% reduction to about 35% reduction, about 35% reduction to about 99% reduction, about 35% reduction to about 95% reduction, about 35% reduction to about 90% reduction, about 35% reduction to about 85% reduction, about 35% reduction to about 80% reduction, about 35% reduction to about 75% reduction, about 35% reduction to about 70% reduction, about 35% reduction to about 65% reduction, about 35% reduction to about 60% reduction, about 35% reduction to about 55% reduction, about 35% reduction to about 50% reduction, about 35% reduction to about 45% reduction, about 35% reduction to about 40% reduction, about 40% reduction to about 99% reduction, about 40% reduction to about 95% reduction, about 40% reduction to about 90% reduction, about 40% reduction to about 85% reduction, about 40% reduction to about 80% reduction, about 40% reduction to about 75% reduction, about 40% reduction to about 70% reduction, about 40% reduction to about 65% reduction, about 40% reduction to about 60% reduction, about 40% reduction to about 55% reduction, about 40% reduction to about 50% reduction, about 40% reduction to about 45% reduction, about 45% reduction to about 99% reduction, about 45% reduction to about 95% reduction, about 45% reduction to about 90% reduction, about 45% reduction to about 85% reduction, about 45% reduction to about 80% reduction, about 45% reduction to about 75% reduction, about 45% reduction to about 70% reduction, about 45% reduction to about 65% reduction, about 45% reduction to about 60% reduction, about 45% reduction to about 55% reduction, about 45% reduction to about 50% reduction, about 50% reduction to about 99% reduction, about 50% reduction to about 95% reduction, about 50% reduction to about 90% reduction, about 50% reduction to about 85% reduction, about 50% reduction to about 80% reduction, about 50% reduction to about 75% reduction, about 50% reduction to about 70% reduction, about 50% reduction to about 65% reduction, about 50% reduction to about 60% reduction, about 50% reduction to about 55% reduction, about 55% reduction to about 99% reduction, about 55% reduction to about 95% reduction, about 55% reduction to about 90% reduction, about 55% reduction to about 85% reduction, about 55% reduction to about 80% reduction, about 55% reduction to about 75% reduction, about 55% reduction to about 70% reduction, about 55% reduction to about 65% reduction, about 55% reduction to about 60% reduction, about 60% reduction to about 99% reduction, about 60% reduction to about 95% reduction, about 60% reduction to about 90% reduction, about 60% reduction to about 85% reduction, about 60% reduction to about 80% reduction, about 60% reduction to about 75% reduction, about 60% reduction to about 70% reduction, about 60% reduction to about 65% reduction, about 65% reduction to about 99% reduction, about 65% reduction to about 95% reduction, about 65% reduction to about 90% reduction, about 65% reduction to about 85% reduction, about 65% reduction to about 80% reduction, about 65% reduction to about 75% reduction, about 65% reduction to about 70% reduction, about 70% reduction to about 99% reduction, about 70% reduction to about 95% reduction, about 70% reduction to about 90% reduction, about 70% reduction to about 85% reduction, about 70% reduction to about 80% reduction, about 70% reduction to about 75% reduction, about 75% reduction to about 99% reduction, about 75% reduction to about 95% reduction, about 75% reduction to about 90% reduction, about 75% reduction to about 85% reduction, about 75% reduction to about 80% reduction, about 80% reduction to about 99% reduction, about 80% reduction to about 95% reduction, about 80% reduction to about 90% reduction, about 80% reduction to about 85% reduction, about 85% reduction to about 99% reduction, about 85% reduction to about 95% reduction, about 85% reduction to about 90% reduction, about 90% reduction to about 99% reduction, about 90% reduction to about 95% reduction, or about 95% reduction to about 99% reduction) in the volume of one or more solid tumors in the subject (e.g., as compared to the volume of the one or more solid tumors prior to treatment or at the start of treatment). In some embodiments, the these methods can reduce (e.g., about 1% reduction to about 99% reduction, or any of the subranges of this range described herein) the risk of developing a metastasis or developing one or more additional metastasis in a subject (e.g., as compared to the risk of developing a metastasis or developing one or more additional metastasis in a subject prior to treatment or in a similar subject or a population of subjects administered a different treatment).

In some embodiments, these methods can result in treatment of metabolic disease in the subject. In some embodiments, the treatment of metabolic disease can result in, e.g., one or more (e.g., two, three, four, five, or six) improved glucose tolerance, improved glucose utilization, decreased severity or progression of diabetic osteoarthropathy, decreased severity or progression of skin lesions, decreased severity or progression of ketosis, decreased generation of autoantibodies against islet cells, increased insulin sensitivity, decreased mass, and decreased body mass index. The response of a subject to treatment can be monitored by determining fasting glucose or glucose tolerance according to standard techniques. Typically, in accordance with the method, blood glucose is lowered so as to achieve a blood glucose level characterized by a fasting blood glucose of less than 100 mg/dL or a two-hour 75-g oral glucose tolerance test values of less than 140 mg/dL. In some embodiments, response to treatment may include determining other factors relevant to pre-diabetes, new-onset diabetes, or active diabetes including blood pressure, body mass index, PPAR-y function, lipid metabolism, glycated hemoglobin (H1c), and renal function.

In some embodiments, these methods can eliminate or reduce the risk, lessen the severity, or delay the outset of the neurodegenerative disease, including biochemical, histologic and/or behavioral symptoms of the disease, its complications and intermediate pathological phenotypes presenting during development of the disease.

In some embodiments, effective treatment of a skin disease can be assessed by any method described herein or known in the art, including inspecting skin conditions that include skin color, moisture, temperature, texture, mobility and turgor, and skin lesions, as compared to the skin conditions prior to treatment.

In some embodiments, effective treatment of an autoimmune disease can be assessed by any method described herein or known in the art, including monitoring full blood count analysis on freshly isolated PBMCs, total Ig levels, and analysis of serum autoantibody titers.

In some embodiments, effective treatment of a fragility disease can be assessed by any method described herein or known in the art, including monitoring bone mineral density, bone architecture and geometry, biomedical markers of bone turnover, vitamin D measurement, Karnofsky performance status and ECOG scores, and responsiveness to vaccination.

Methods of Killing or Reducing the Number of Senescent Cells in a Subject

Provided herein are methods of killing or reducing the number of senescent cells (e.g. any of the exemplary types of senescent cells described herein or known in the art) in a subject in need thereof that include administering to the subject a therapeutically effective amount of one or more NK cell activating agent(s) (e.g. any of the NK cell activating agent(s) described herein or known in the art).

Also provided herein are methods of killing or reducing the number of senescent cells (e.g. any of the exemplary types of senescent cells described herein or known in the art) in a subject in need thereof that include administering to the subject a therapeutically effective amount of activated NK cells (e.g. any of the activated NK cells described herein or known in the art).

Some embodiments of these methods further include: obtaining a resting NK cell; and contacting the resting NK cell in vitro in a liquid culture medium including one or more NK cell activating agent(s), where the contacting results in the generation of the activated NK cells that are subsequently administered to the subject. In some examples of these methods, the resting NK cell is an autologous NK cell obtained from the subject. In some examples of these methods, the resting NK cell is a haploidentical NK cell obtained from the subject. In some examples of these methods, the resting NK cell is an allogeneic resting NK cell. In some examples of these methods, the resting NK cell is an artificial NK cell. In some examples of any of these methods, the resting NK cell is a genetically-engineered NK cell carrying a chimeric antigen receptor or recombinant T cell receptor.

In some examples of these methods, the liquid culture medium is a serum-free liquid culture medium. In some embodiments of any of the methods described herein, the liquid culture medium is a chemically-defined liquid culture medium. Some examples of these methods further include isolating the activated NK cells (and further administering a therapeutically effective amount of the activated NK cells to a subject, e.g., any of the subjects described herein). In some embodiments of these methods, the contacting step is performed for a period of about 2 hours to about 20 days (or any of the subranges of this range described herein).

In some embodiments of these methods, the senescent cells are senescent cancer cells, senescent monocytes, senescent lymphocytes, senescent astrocytes, senescent microglia, senescent neurons, senescent tissue fibroblasts, senescent dermal fibroblasts, senescent keratinocytes, or other differentiated tissue-specific dividing functional cells. In some embodiments of these methods, senescent cancer cells are chemotherapy-induced senescent cells or radiation-induced senescent cells.

In some embodiments of these methods, the subject has been identified or diagnosed as having an aging-related disease or condition (e.g., any of the aging-related diseases or conditions described herein or known in the art). In some embodiments of any of the aging-related disease or condition described herein, the aging-related disease or condition is selected from the group of: a cancer, an autoimmune disease, a metabolic disease, a neurodegenerative disease, a cardiovascular disease, a skin disease, a progeria disease, and a fragility disease.

Non-limiting examples of cancer include: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, B-cell lymphoma, B-cell non-Hodgkin's lymphoma, Hodgkin's lymphoma, chronic lymphocytic leukemia (CLL), acute myeloid leukemia (AML), chronic myeloid leukemia (CML), acute lymphocytic leukemia (ALL), myelodysplastic syndromes (MDS), cutaneous T-cell lymphoma, retinoblastoma, stomach cancer, urothelial carcinoma, lung cancer, renal cell carcinoma, gastric and esophageal cancer, pancreatic cancer, prostate cancer, breast cancer, colorectal cancer, ovarian cancer, non-small cell lung carcinoma, squamous cell head and neck carcinoma, endometrial cancer, cervical cancer, liver cancer, and hepatocellular carcinoma.

A non-limiting example of an autoimmune disease is type-1 diabetes.

Non-limiting examples of metabolic disease include: obesity, a lipodystrophy, and type-2 diabetes mellitus.

Non-limiting examples of neurodegenerative disease include: Alzheimer's disease, Parkinson's disease, and dementia.

Non-limiting examples of cardiovascular disease include: coronary artery disease, atherosclerosis, and pulmonary arterial hypertension.

Non-limiting examples of skin disease include: wound healing, alopecia, wrinkles, senile lentigo, skin thinning, xeroderma pigmentosum, and dyskeratosis congenita.

Non-limiting examples of progeria disease include: progeria and Hutchinson-Gilford Progeria Syndrome.

Non-limiting examples of fragility disease include: frailty, responsiveness to vaccination, osteoporosis, and sarcopenia.

In some embodiments of any of the aging-related disease or condition described herein, the aging-related disease or condition is selected from the group of: age-related macular degeneration osteoarthritis, adipose atrophy, chronic obstructive pulmonary disease, idiopathic pulmonary fibrosis, kidney transplant failure, liver fibrosis, loss of bone mass, sarcopenia, age-associated loss of lung tissue elasticity, osteoporosis, age-associated renal dysfunction, and chemical-induced renal dysfunction.

In some embodiments of any of the aging-related disease or condition described herein, the aging-related disease or condition is type-2 diabetes or atherosclerosis.

In some embodiments of these methods, the administering results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 10% decrease to about a 99% decrease (or any of the subranges of this range described herein)) in the number of senescent cells in a target tissue in the subject, e.g., as compared to the number of senescent cells in the target tissue in the subject prior to treatment. In some embodiments of these methods, the target tissue in the subject can be one or more of an adipose tissue, pancreatic tissue, liver tissue, lung tissue, vasculature, bone tissue, central nervous system (CNS) tissue, eye tissue, skin tissue, muscle tissue, and secondary lympho-organ tissue.

In some embodiments of these methods, the administering results in an increase (e.g., at least a 5% increase, at least a 10% increase, at least a 15% increase, at least a 20% increase, at least a 25% increase, at least a 30% increase, at least a 35% increase, at least a 40% increase, at least a 45% increase, at least a 50% increase, at least a 55% increase, at least a 60% increase, at least a 65% increase, at least a 70% increase, at least a 75% increase, at least a 80% increase, at least a 85% increase, at least a 90% increase, at least a 95% increase, or at least a 99% increase, or about a 10% increase to about a 500% increase (or any of the subranges of this range described herein)) in the levels of IFN-γ, a cytotoxic granule granzyme, and/or perforin in the subject, as compared to the levels in a subject prior to treatment or a similar control subject who has not received a treatment.

In some embodiments of these methods, the number of senescent cells in a target tissue (e.g. any of the target tissues described herein) can be determined by performing immunostaining on a biopsy sample. In some embodiments of these methods, the number of senescent cells in a target tissue (e.g. any of the target tissues described herein) can be observed indirectly through an improvement in one or more symptoms of an aging-related disease or condition (e.g. any of the symptoms of an aging-related disease or condition described herein) in a subject.

Senescent Cells

Senescent cells display important and unique properties which include changes in morphology, chromatin organization, gene expression, and metabolism. There are several biochemical and functional properties associated with cellular senescence, such as (i) increased expression of $p16^{INK4a}$ and $p21^{CIP1}$, inhibitors of cyclin-dependent kinases, (ii) presence of senescence-associated β-galactosidase, a marker of lysosomal activity, (iii) appearance of senescence-associated heterochromatin foci and downregulation of lamin B1 levels, (iv) resistance to apoptosis caused by an increased expression of anti-apoptotic BCL-family protein, and (v) upregulation of CD26 (DPP4), CD36 (Scavenger receptor), forkhead box 4 (FOXO4), and secretory carrier membrane protein 4 (SCAMP4). Senescent cells also express an inflammatory signature, the so-called senescence-associated secretory phenotype (SASP). Through SASP, the senescent cells produce a wide range of inflammatory cytokines (IL-6, IL-8), growth factors (TGF-β), chemokines (CCL-2), and matrix metalloproteinases (MMP-3, MMP-9) that operate in a cell-autonomous manner to reinforce senescence (autocrine effects) and communicate with and modify the microenvironment (paracrine effects). SASP factors can contribute to tumor suppression by triggering senescence surveillance, an immune-mediated clearance of senescent cells. However, chronic inflammation is also a known driver of tumorigenesis, and accumulating evidence indicates that chronic SASP can also boost cancer metastasis and aging-related diseases.

The secretion profile of senescent cells is context dependent. For instance, the mitochondrial dysfunction-associated senescence (MiDAS), induced by different mitochondrial dysfunction in human fibroblasts, led to the appearance of a SASP that was deficient in IL-1-dependent inflammatory factors. A decrease in the NAD+/NADH ratio activated AMPK signaling which induced MiDAS through the activation of p53. As a result, p53 inhibited NF-κB signaling which is a crucial inducer of pro-inflammatory SASP. In contrast, the cellular senescence caused by persistent DNA damage in human cells induced an inflammatory SASP, which was dependent on the activation of ataxia-telangiectasia mutated (ATM) kinase but not on that of p53. In particular, the expression and secretion levels of IL-6 and IL-8 were increased. It was also demonstrated that cellular senescence caused by the ectopic expression $p16^{INK4a}$ and $p21^{CIP1}$ induced the senescent phenotype in human fibroblasts without an inflammatory SASP indicating that the growth arrest itself did not stimulate SASP.

One of the most defining characteristics of senescence is stable growth arrest. This is achieved by two important pathways, the $p16^{INK4a}$/Rb and the $p53/p21^{CIP1}$, both of which are central in tumor suppression. DNA damage results in: (1) high deposition of γH2Ax (histone coding gene) and 53BP1 (involved in DNA damage response) in chromatin: this leads to activation of a kinase cascade eventually resulting in p53 activation, and (2) activation of p16INK4a and ARF (both encoded by CDKN2A) and P15INK4b (encoded by CDKN2B): p53 induces transcription of cyclin-dependent kinase inhibitor ($p21^{CIP1}$) and along with both p16INK4a and p15INK4b block genes for cell cycle progression (CDK4 and CDK6). This eventually leads to hypophosphorylation of Retinoblastoma protein (Rb) and cell cycle arrest at the G1 phase.

Selectively killing senescent cells has been shown to significantly improve the health span of mice in the context of normal aging and ameliorates the consequences of age-related disease or cancer therapy (Ovadya, *J Clin Invest*. 128(4):1247-1254, 2018). In nature, the senescent cells are normally removed by the innate immune cells. Induction of senescence not only prevents the potential proliferation and transformation of damaged/altered cells, but also favors tissue repair through the production of SASP factors that function as chemoattractants mainly for Natural Killer (NK) cells (such as IL-15 and CCL2) and macrophages (such as CFS-1 and CCL2). These innate immune cells mediate the immunosurveillance mechanism for eliminating stressed cells. Senescent cells usually up-regulate the NK-cell activating receptor NKG2D and DNAM1 ligands, which belong to a family of stress-inducible ligands: an important component of the frontline immune defense against infectious diseases and malignancies. Upon receptor activation, NK cells can then specifically induce the death of senescent cells through their cytolytic machinery. A role for NK cells in the immune surveillance of senescent cells has been pointed out in liver fibrosis (Sagiv, Oncogene 32(15): 1971-1977, 2013), hepatocellular carcinoma (Iannello, *J Exp Med* 210(10): 2057-2069, 2013), multiple myeloma (Soriani, *Blood* 113 (15): 3503-3511, 2009), and glioma cells stressed by dysfunction of the mevalonate pathway (Ciaglia, *Int J Cancer* 142(1): 176-190, 2018). Endometrial cells undergo acute cellular senescence and do not differentiate into decidual cells. The differentiated decidual cells secrete IL-15 and thereby recruit uterine NK cells to target and eliminate the undifferentiated senescent cells thus helping to re-model and rejuvenate the endometrium (Brighton, *Elife* 6: e31274, 2017). With a similar mechanism, during liver fibrosis, p53-expressing senescent liver satellite cells skewed the polarization of resident Kupfer macrophages and freshly infiltrated macrophages toward the pro-inflammatory M1 phenotype, which display senolytic activity. F4/80+ macrophages have been shown to play a key role in the clearance of mouse uterine senescent cells to maintain postpartum uterine function.

Senescent cells recruit NK cells by mainly upregulating ligands to NKG2D (expressed on NK cells), chemokines, and other SASP factors. In vivo models of liver fibrosis have shown effective clearance of senescent cells by activated NK cells (Krizhanovsky, *Cell* 134(4): 657-667, 2008). Studies have described various models to study senescence including liver fibrosis (Krizhanovsky, *Cell* 134(4): 657-667, 2008), osteoarthritis (Xu, *J Gerontol A Biol Sci Med Sci* 72(6): 780-785, 2017), and Parkinson's disease (Chinta, *Cell Rep* 22(4): 930-940, 2018). Animal models for studying senescent cells are described in: Krizhanovsky, *Cell* 134(4): 657-667, 2008; Baker, *Nature* 479(7372): 232-236, 2011; Farr, *Nat Med* 23(9): 1072-1079, 2017; Bourgeois, *FEBS Lett* 592(12): 2083-2097, 2018; Xu, *Nat Med* 24(8): 1246-1256, 2018).

Senescence is a form of irreversible growth arrest accompanied by phenotypic changes, resistance to apoptosis and activation of damage-sensing signaling pathways. Cellular senescence was first described in cultured human fibroblast cells that lost their ability to proliferate, reaching permanent arrest after about 50 population doublings (referred to as the Hayflick limit) (Hayflick et al., *Exp. Cell Res.* 25:585-621, 1961). He observed a phenomenon of "replicative senescence" in cultures of non-immortalized human fibroblasts which is caused by a progressive telomere shortening upon each cell division and represents a physiological response to prevent genomic instability and therefore accumulation of DNA damage (He et al., *Cell* 169(6):1000-1011, 2017).

Senescence is considered a stress response that can be induced by a wide range of intrinsic and extrinsic insults, including oxidative and genotoxic stress, DNA damage, telomere attrition, or oncogenic activation, mitochondrial dysfunction, or chemotherapeutic agents (McHugh et al., *J. Cell Biol.* 217(1):65-77, 2018). This accelerated senescence response, independent from the telomere shortening, is known as premature senescence. Senescence has been linked to various age-related complications like diabetes, osteoporosis, cardiovascular diseases, dementia, neurodegenerative disorders, renal failure, and sarcopenia. It is also interesting to note that the aging is the single biggest risk factor for cancer (McHugh et al., *J. Cell Biol.* 217(1):65-77, 2018; Childs et al., *Nat. Rev. Drug Discov.* 16(10):718-735, 2017).

Senescent cells remain metabolically active and can influence the tissue hemostasis, disease and aging through their secretory phenotype (He et al., *Cell* 169(6):1000-1011, 2017). Senescence is considered as a physiologic process and is important in promoting wound healing, tissue homeostasis (Brighton et al., *Elife* 6, 2017), regeneration, embryogenesis, fibrosis regulation, etc. (von Kobbe, *Cell Mol. Life Sci.* 2018). For instance, transient induction of senescent cells is observed during would healing and contributes to wound resolution. Perhaps one of the most important roles of senescence is its role in tumorigenesis suppression (von Kobbe, *Cell Mol. Life Sci.* 2018). However, the accumulation of senescent cells also drives aging and aging-related diseases. The senescent phenotype also can trigger chronic inflammatory responses and consequently augment chronic inflammatory conditions to promote tumor growth. The connection between senescence and aging was initially based on observations that senescent cells accumulate in aged tissue. In the last decade, our understanding of senescence's detrimental consequences in aging and age-related pathologies has expanded significantly. The use of transgenic models enabled the detection of senescent cells systematically in many age-related pathologies. The development of genetic and senolytic drugs strategies to selectively eliminate senescent cells has demonstrated that senescent cells can indeed play a causative role in aging and related pathologies.

Senescent cells display important and unique properties which include changes in morphology, chromatin organization, gene expression, and metabolism. There are several biochemical and functional properties associated with cellular senescence, such as (i) increased expression of $p16^{INK4a}$ and $p21^{CIP1}$, inhibitors of cyclin-dependent kinases, (ii) presence of senescence-associated β-galactosidase, a marker of lysosomal activity, (iii) appearance of senescence-associated heterochromatin foci and downregulation of lamin B1 levels, (iv) resistance to apoptosis caused by an increased expression of anti-apoptotic BCL-family protein, (v) upregulation of CD26 (DPP4) (Kim et al., *Genes Dev.* 31(15):1529-1534, 2017), CD36 (Scavenger receptor) (Chong et al., *EMBO Rep.* 19(6), 2018), forkhead box 4 (FOXO4) (Bourgeois et al., *FEBS Lett.* 592(12): 2083-2097, 2018), and secretory carrier membrane protein 4 (SCAMP4) (Kim et al., *Genes Dev.* 32(13-14): 909-914, 2018), (vi) accumulation of lipofuscin, and (vii) expression of embryonic chondrocyte-expressed 1 and decoy death receptor 2. Senescent cells also express an inflammatory signature, the so-called SASP. Through SASP, the senescent cells produce a wide range of inflammatory cytokines (IL-1α, IL-1β, IL-6, IL-8, TNF-α), growth factors (TGF-β, PDGF-AA, insulin-like growth factor-binding proteins (IGFBPs)), chemokines (CCL-2, CCL-20, CCL-7, CXCL-4, CXCL1, and CXCL-12), and matrix metalloproteinases (MMP-3, MMP-9) that operate in a cell-autonomous manner to reinforce senescence (autocrine effects) and communicate with and modify the microenvironment (paracrine effects) (Milanovic et al., *Nature* 553(7686):96-100, 2018). IL-1α is considered one of the master regulators of the SASP. The release of IL-1α by senescent cells transmits senescence to normal cells. IFN can also induce senescence by triggering DNA damage in the target cells. IGFBs can modulate the insulin-like growth factor (IGF) pathway, IGF can act as a potent inducer of senescence. TGF-β, secreted as one of the SASP factors, can induce and maintain a senescent phenotype and age-related pathological conditions in an autocrine/paracrine manner. Integrin β3, regulated by the polycom protein CBX7, was upregulated during senescence, promoted senescence by activating TGF-β signaling in an autocrine/paracrine manner, and reinforced the SASP in human fibroblasts. In addition, the TGF-β-mediated accumulation of senescent cells has been suggested in idiopathic pulmonary fibrosis. A recent report showed that TGF-β signaling induced the reduction of H4K20me3 abundance, which compromised DNA damage repair and restored and promoted senescence, by upregulating miR-29a/c and downregulating its target in Suv4-20h in fibroblasts. This pathway contributed to cardiac aging in vivo, and the inhibition of TGF-β signaling restored H4K20me3 and improved cardiac function in older mice.

Matrix metalloproteinases (MMPs) are important elements of SASP, including MMP-1 and -3, which can act as regulatory elements of senescence. They can cleave IL-8, IL-1, VEGF, and other CXCL/CCL family chemokines. In addition, senescent cells secrete serine proteases like urokinase- or tissue-type plasminogen activators.

The SASP is also composed of non-macromolecular elements such as nitric oxide and reactive oxygen species that can affect the phenotype of neighboring cells.

The secretion profile of senescent cells is context dependent. For instance, the mitochondrial dysfunction-associated senescence (MiDAS), induced by different mitochondrial dysfunction in human fibroblasts, led to the appearance of a SASP that was deficient in IL-1-dependent inflammatory factors (Wiley et al., *Cell Metab.* 23(2):303-314, 2016). A decrease in the NAD+/NADH ratio activated AMPK signaling which induced MiDAS through the activation of p53. As a result, p53 inhibited NF-κB signaling which is a crucial inducer of pro-inflammatory SASP (Salminen et al., *Cell*

Signal. 24(4):835-845, 2012). In contrast, the cellular senescence caused by persistent DNA damage in human cells induced an inflammatory SASP, which was dependent on the activation of ataxia-telangiectasia mutated (ATM) kinase but not on that of p53 (Rodier et al., Nat. Cell Biol. 11(8): 973-979, 2009). In particular, the expression and secretion levels of IL-6 and IL-8 were increased. It was also demonstrated that cellular senescence caused by the ectopic expression p16$^{INK4a}$ and p21$^{CIP1}$ induced the senescent phenotype in human fibroblasts without an inflammatory SASP indicating that the growth arrest itself did not stimulate SASP (Coppe et al., J. Biol. Chem. 286(42): 36396-36403, 2011). These indicate that the senescent phenotype have a crucial role in the control of the nature of SASP and its physiological and pathological consequences.

Thus, multiple components of the SASP have the ability to drive senescence in a paracrine manner in nearby non-senescent cells to increase the overall number of senescent cells. By means of the SASP, senescent cells can also influence the tissue microenvironment via paracrine mechanism to influence neighboring proliferating cells and the recruitment and activation of immune cells in aging tissues and tumors.

SASP factors can contribute to tumor suppression by triggering senescence surveillance, an immune-mediated clearance of senescent cells. However, chronic inflammation is also a known driver of tumorigenesis, and accumulating evidence indicates that chronic SASP can also boost cancer and aging-related diseases. Recently, it has also been shown that senescent cells affect neighboring cells by direct intercellular protein transfer (Biran et al., Genes Dev. 29(8):791-802, 2015). Proteins transferred from senescent cells to recipient neighboring cells triggered activation of signaling pathways in these cells which led to changes in their cellular behavior. A recent study showed that chemotherapy-induced senescent cancer cells engulfed neighboring senescent or non-senescent cancer cells. The engulfment occurred even in the presence of a cell-death inhibitor p53. The ingested cells are degraded in lysosomes. The senescent cells that ate their neighbors survived longer in vitro than those that did not. This suggested that the metabolic building blocks retrieved from the lysosomal digestion of neighboring cells were being used by senescent cells to promote their survival. The engulfment was mainly through the phagocytosis rather than the entosis mechanism of action. It was proposed that cell cannibalism might affect cancer progression by supporting the SASP response. However, this newly acquired capability of chemotherapy-induced senescent cancer cells could promote or facilitate cancer-cell metastasis directly by removing particular cells from the tumor microenvironment. If normal cells are also found to be removed by senescent cells in aged tissues, this might directly cause tissue degradation.

In summary, all components of SASP contribute to the local inflammatory environment and may contribute to the inflammaging phenomenon.

Most of the SASP components are regulated by the nuclear factor kappa light-chain-enhancer of activated B cells (NF-κB), CCAAT/enhancer-binding protein beta (CEBP/13) and by mTOR. The transcription factor GATA4, acting upstream of NF-κB, is also required for senescence establishment and SASP induction. Another regulator of SASP is the bromodomain and extraterminal domain (BET) family member bromodomain-containing protein 4 (BRD4) that positively regulates the senescence secretome and promotes senescence immune clearance. The SASP is also regulated by signal transducer and activator of transcription 3 (STAT3) in certain tissues. In addition, the mixed-lineage leukemia 1 (MLL1) has also been reported to enable the SASP, mainly by inducing genes required for the DNA replication and for the DDR activation. Other SASP regulators include NOTCH1 and the high mobility group B proteins (HMGB1 and HMGB2). Recent data also demonstrate that the SASP can be controlled by the cGAS/STING pathway. cGAS is a DNA sensor that, through the adaptor protein STING, triggers cellular senescence and the transcription of genes that control the SASP.

One of the most defining characteristics of senescence is stable growth arrest. This is achieved by the p53/p21$^{CIP1}$p21$^{cip1}$ and p16$^{INK4a}$/Rb pathways (McHugh et al., J. Cell Biol. 217(1):65-77, 2018). DNA damage and/or DNA damage responses (DDR) critically control these two pathways.

(1) p53/p21$^{CIP1}$p21$^{cip1}$: p53 plays a pivotal role in cellular senescence and its activation can be DDR-dependent or DDR-independent. In the telomere DDR-dependent case, telomere attrition, DNA damage, as well as hyperactivation of oncogenes and inactivation of onco-suppressors (oncogene induced senescence, OIS) resulting from replicative stress activate the DNA damage repair cascade. DDR activates the stress sensors' ataxia-telangiectasia mutated kinase (ATM) or ataxia telangiectasia and Rad3-related (ATR) kinase. ATM/ATR, in turn, activate the p53/p21$^{CIP1}$p21cip1 axis by phosphorylating both p53 and its ubiquitin ligase Mdm2, leading to the stabilization of p53 levels. P53 is directly phosphorylated in Ser-15 and indirectly phosphorylated in Ser-20 via Chk1/2. Many recent studies also demonstrated that several OIS pathways can actually activate p53p35 bypassing the DDR. These demonstrated once again that the crucial role of p53 and p53-triggered senescence for the suppression of tumorigenesis after the onset of a first mutation.

The stabilization of the p53 protein upregulates p21$^{CIP1}$. p21$^{CIP1}$p21$^{cip1}$. p21$^{cip1}$, a member of the mammalian cyclin-dependent kinase (CDK) inhibitor family, is required for the p53-induced cell cycle arrest at either GUS or G2/M checkpoints. p21$^{CIP1}$p21cip1, encoded by the CDKN1A gene located on chromosome 6 in humans, is a potent cyclin-dependent kinase inhibitor (CKI). It binds to and inhibits the activity of cyclin-CDK2, -CDK1, and -CDK4/6 complexes, and thus functions as a regulator of cell cycle progression at G1 and S phase. p21$^{CIP1}$p21$^{cip1}$ also mediates the gene expression modulation of many p53 targets such as CDC25C, CDC25B, and surviving, mainly through the E4F4 complex recruitment. p21$^{CIP1}$p21$^{cip1}$ also promotes senescence through the inhibition of apoptosis. It binds many apoptosis agents, including many caspases. P21$^{CIP1}$P21cip1 knockout in senescent cells provokes programmed cell death through the caspase activation cascade. p21$^{CIP1}$p21cip1 is also capable of inducing senescence independently from p53 activity. It was shown that Chk2 was able to induce p21cip1 expression in p53-defective cell lines, contributing to Chk2-mediated senescence.

(2) p16$^{INK4a}$/Rb: Three tumor suppressors reside in the INK4/ARF locus: p16$^{INK4a}$ and ARF, which are both encoded by the CNDN2A gene, and p15$^{INK4b}$, which is encoded by CDKN2B gene. p15$^{INK4b}$ and p16$^{INK4a}$, are CDKIs, like p21$^{CIP1}$, that affect the cell cycle by binding and inhibiting CDK4 and CDK6. In contrast, ARF inhibits MDM2, thereby allowing cross talk with p53/p21$^{CIP1}$ pathways. The INK4/ARF locus behaves as a senescence sensor. In young, normal cells, the INK4/ARF locus is epigenetically silenced through deposition of repressive H3K27me3 marks. H3K27 methylation is controlled by polycom repressive complexes, PRC2 and PRC3. Disrupting PRC1 or PRC2 activity by depleting the expression of some of their components depresses $p16^{INK4a}$ and induces senescence. During senescence, the H3K27 histone demethylase JMJD3 plays a role in removing the repressive marks around the INK4/ARF locus, facilitating its induction. INK4/ARF induction can be observed in tissues during natural aging. In particular, $p16^{INK4a}$ is considered an aging biomarker.

In summary, p53 induces transcription of cyclin-dependent kinase inhibitor $p21^{CIP1}$ and along with both p16INK4a and p15INK4b block genes for cell cycle progression (CDK4 and CDK6). This eventually leads to hypophosphorylation of Retinoblastoma protein (Rb) and cell cycle arrest at the G1 phase (McHugh et al., *J. Cell Biol.* 217(1):65-77, 2018).

While the $p53/p21_{CIP1}$ pathway seems to play a key role in the initiation of senescence, the pathway involving $p16^{INK4a}$ and the RB family seems to have a central role in the maintenance of senescence. This was suggested by the observation of a decrease in p53 levels after induction of senescence, while $p16^{INK4a}$ levels maintains steadily high. It has also been shown that the downregulation of p53 in senescent cells has different effects depending on p16 activity. p53 succeeds in inducing replication and cell growth in cells with low levels of p16INK4a, while it does not in cells with high $p16^{INK4a}$ activity. These findings suggest that the activation of $p16^{INK4a}$/Rb pathway is responsible for drawing a line between two different phases of senescence: the early and reversible phase is dominated by p53 activity and the irreversible phase is induced by the $p16^{INK4a}$/Rb pathway.

Recently, the cGAS-cGAMP-STING pathway has emerged as an important link from DNA damage to inflammation, cellular senescence, and cancer (Tuo et al., *J. Exp. Med.* 215(5):1287-1299, 2018). This pathway detects cytoplasmic DNA after DNA damage and activate type I IFNs and other cytokines. Although both DNase2 and TREX1 rapidly remove the cytoplasmic DNA fragments emanating from the nucleus in pre-senescent cells, the expression of these DNases is downregulated in senescent cells, resulting in the cytoplasmic accumulation of nuclear DNA. This causes the aberrant activation of cGAS-STING cytoplasmic DNA sensors, provoking SASP through induction of IFN-β (Takahashi et al., *Nature Comm.* 9:1249, 2018)

The transforming growth factor-β (TGF-β) is a superfamily of evolutionarily conserved cytokines that mediate a diverse range of signaling functions to provide tissue-specific control of cell differentiation and proliferation. They also promote or protect against cell death, promote extracellular matrix protein expression, cell motility and invasion, and control cell metabolism.

The human TGF-β family includes thirty-three genes that encode for homodimeric or heterodimeric secreted cytokines. The family members include activins, the bone morphogenetic proteins, the growth differentiation factors, the Mullerian inhibiting substance, the nodal and the TGF-βs. The TGF-β family proteins are synthesized as precursor molecules consisting of a signal peptide, a prodomain (termed latency-associated peptide (LAP), for TGF-β), and the mature polypeptide. The removal of the short N-terminal signal peptide allows protein folding, glycosylation, and processing in subsequent biosynthetic steps during transport from the endoplasmic reticulum to the Golgi apparatus. Dimerization via disulfide linkage is followed by proteolytic cleavage of the polypeptide by furin family proteases resulting in the formation of an N-terminal long dimeric and disulfide-linked LAP, and a C-terminal short dimeric disulfide-linked mature TGF-β. The LAP and mature TGF-β remain associated with each other and form the latent form of the ligand called small latency complex (SLC), structural analysis of this latent form of TGF-β shows that LAP directly covers the critical amino acids of the C-terminal dimer that are later used for interaction with the signaling receptors and thus confers inactivation of the mature TGF-β dimer. Concomitant to the processing of TGF-β polypeptide, crosslinking of the N-terminal LAP through disulfide bonding to other secreted proteins, latent TGF-β binding proteins (LTBPs), takes place to form large latent complex (LLC). LTBPs are extracellular protein, and upon secretion, mediate deposition of LLC to the extracellular matrix (EMC) via their ability to crosslink with other proteins of the ECM such as fibronectin and fibrillins. Thus, LTBPs provide the scaffolding units that tether latent TGF-βs to the ECM. The latent complexes of the three TGF-βs require activation mechanisms to release the mature ligand; however, only the activation of the TGF-β1 complex has been well characterized. The diverse modes of latent extracellular latent TGF-β activation in physiologically relevant settings, which include proteolysis, low pH, reactive oxygen species, bind to other proteins, and mechanical deformation by shear or integrin-mediated cell pulling, suggest cell type-selective of tissue-selective mechanisms that may be depend on the signaling context. In various contexts, one side of the LAP in the SLC is covalently cross-linked via Cys33 residue to the 8-Cys domain of the LTBP, which in turn is linked to the ECM. With this resistance, pulling the other end of the LAP via integrins-notably αvβ1, αvβ6, and αvβ8-enables changes in conformation of latent TGF-β complex that result in the release of the active TGF-β1 from LLC. Various proteases also confer activation of latent TGF-β. Many studies strongly suggest that physiological activation of latent TGF-β1 requires combined activities of integrins and proteases. Instead of association with an LTBP, the latent TGF-β complex has also been found to be disulfide-linked to a membrane associated protein named GARP, also known as LRRC32, or the closely related LRRC33. GARP is primarily expressed in immune cells such as regulatory T cells (Tregs). The function of GARP has been extensively studied on Tregs, where it complexes with αvβ8 integrins to release active TGF-β from the surface of the cells. GARP was shown to be involved in enhancing Tregs-mediated peripheral tolerance. In platelets, it has also been shown that thrombin cleaves GARP resulting in liberation of active TGF-β1 from the GARP-LAP-TGF-β1 complexes.

Once activated from their LAPs, all three TGF-β isoforms act through the same heteromeric transmembrane TGF-β receptor complex, formed by dimeric TGF-β type I receptor (RI) alk5 (aka TβR1) and the dimeric TGF-β type II receptor (RII) TGFβRII. TGF-β associates first with a homodimeric TGFβRII. This interaction causes a conformational adaption between the ligand and TGFβRII, in a manner that a new high-affinity binding site is formed for TGFβRI at the interface of ligand and TGFβRII. Upon recruitment of the two units of TGFβRI, the type II receptor kinase phosphorylates serine and threonine residues in the juxta-membrane subdomain of TGFβRI that is characterized by a short glycine- and serine-rich motif (GS), which then induces conformational changes that release the immunophilin FKBP12 from the GS domain. This dissociation relieves the inhibitory interaction of the kinase domain with GS domain and activates the kinase in the type I receptors. Upon ligand-induced receptor activation, the TGFβRI then activates effector SMADs through phosphorylation of their two C-terminal serine residues. Specifically, the type I receptor phosphorylates two different SMAD proteins in the case of TGF-β (and other family members such as activins and nodal), SMAD2 and SMAD3, or three different SMAD proteins in the case of BMPs (also some GDFs and other ligand members), SMAD1, SMAD5, and SMAD8. These "receptor-activated SMADs" (R-SMADs) then dissociate from the receptor and combine with SMAD4 to form complexes that translocate into the nucleus, where they cooperate with high-affinity DNA binding transcription factors and coregulators to activate or repress target genes. SMAD complexes not only direct gene transcription that then leads to secondary gene expression changes but also control mRNA splicing, miRNA expression and processing, and epigenetic changes. With further diversity in SMAD complex formation, the SMAD signaling pathway is highly versatile, context-dependent, and nuanced pathway that controls gene expression.

In addition to the canonical SMAD signaling, TGF-β can regulate downstream cellular responses also via other signal transducers in a context-dependent manner. These include the ERK MAP kinase pathway, the JNK and p38 MAP kinase pathway (via TAK1), the PI3-AKT pathway, the JAK-STAT pathway, the Rho-(like) GTPase pathway, and the TGF-β type I receptor intracellular domain signaling pathway. It is well known now that the extensive functional versatility and dependence of the SMADS are on these non-canonical pathways.

Since TGF-βs control the differentiation of most, if not all, cell lineages and regulate many aspects of cell and tissue homeostasis, deregulation of TGF-β signaling leads to developmental anomalies and diseases. Accumulated evidence has indicated that the impairment of TGF-β signaling in certain cell types and the regulation of TGF-β ligands contribute to cellular senescence, cell degeneration, tissue fibrosis, inflammation, decreased regeneration capacity, and metabolic malfunction.

TGF-β1, secreted as one of the SASP factors, can induce or accelerate, and maintain a senescent phenotype in various cell types including fibroblasts, bronchial epithelial cells, and cancers in an autocrine/paracrine manner. Integrin β3, regulated by the polycom protein CBX7, was upregulated during senescence, promoted senescence by activating TGF-β signaling in an autocrine/paracrine manner, and reinforced the SASP in human fibroblasts. In addition, the TGF-β1-mediated accumulation of senescent cells has been suggested in idiopathic pulmonary fibrosis. A recent report showed that TGF-β1 signaling induced the reduction of H4K20me3 abundance, which compromised DNA damage repair and restored and promoted senescence, by upregulating miR-29a/c and downregulating its target, Suv4-20h in fibroblasts. This pathway contributed to cardiac aging in vivo, and the inhibition of TGF-β signaling restored H4K20me3 and improved cardiac function in older mice.

TGF-β1 functions as a senescence driver and induces vascular smooth muscle cell (VSMC) senescence through reactive oxygen species (ROS)-stimulated activation of NF-κB signaling pathway and expression of SASP factors, including plasminogen activator inhibitor type-1 (PAI-1, SERPINE 1). PAI-1 is not only a biomarker of cellular senescence but also is necessary and sufficient for the replicative senescence downstream of p53 and is a key inducer of the senescence program. There is evidence suggesting the existence of a PAI-1/TGF-β1-positive feed-forward mechanism, providing for a model whereby elevated tissue levels of TGF-β1 during the emergence of the senescent phenotype stimulate expression of PAI-1 that, in turn, reinforces continued TGF-β1 synthesis promoting the maintenance, and perhaps expansion, of the senescent VSMC population (Seo et al., *Am. J. Nephrol.* 30:481-490, 2009).

It is well known that senescence has tumor suppressive effects that delay clinical progression following chemotherapy. The last decade has witnessed a big step forward in the understanding of the biology of senescence, especially from it having a tumor-suppressing property to a complex, dynamic, and interactive one that may lead to pro-oncogenic effects on adjacent cancer cells, the stroma and vasculature in the tumor microenvironment (Hoare et al., *Ann. Rev. Cancer Biol.* 2:175-194, 2018). A very elegant study by Milanovic showed in samples from patients with primary B-cell chronic leukemia that senescent cells also upregulated important stem cell related transcripts (Milanovic et al., *Nature* 553(7686):96-100, 2018). Senescent cells have been shown in acute myeloid leukemia (AML) patients where AML blasts induced a senescent phenotype in stromal cells and these stromal cells in turn feedback to promote AML blast survival and proliferation via SASP (Abdul-Aziz et al., *Blood* 133(5):446-456, 2019). Tumors are thought to seize pathophysiological programs of growth regulation that are intended to participate in organ development or tissue repair and 'hijack' this process for oncogenic performance instead of creating novel mechanisms for tumor progression (Milanovic et al., *Trends Cell Biol.* 28(12):1049-1061, 2018). Epigenetic mechanisms have been described to be responsible for senescence induction (H3K9 demethylase) and subsequent stemness (H3K9 demethylase inhibition) acquisition (Yu et al., *Cancer Cell* 33(2):322-336, 2018).

TGF-β1 triggers epithelial-mesenchymal transitions (EMT) through induction of the expression of specific transcription factors Snail and Zeb1/2. EMT provides migratory and invasive behaviors to the cells due to cell adhesion modifications. This process involves a loss of epithelial features and the acquisition features leading to motility and invasive properties. EMT represents an important process leading to the progression and metastasis of cancer cells.

As an immunosuppressive cytokine, TGF-β1 inhibits the function and development of innate and adaptive immune systems including macrophages, natural killer cells, dendritic cells, and T cells. Recent in vivo studies have demonstrated that exposure to tissue- or tumor-derived TGF-β1 can drive the conversion of circulating NK cells into an innate lymphoid cell I (ILC-I)-like phenotype, characterized by a reduction in cytotoxic capacity and the acquisition of several ILC1-associated surface markers. Interestingly, TGF-β1 also synergizes with IL-15 through MAPK pathways to drive the conversion of human NK cells to an ILC-1 like phenotype. TGF-β also represses human NK cell metabolism through its canonical signaling pathway to suppress NK-cell cytotoxicity. TGF-β1 also stimulates regulatory T cells which suppresses the function of other lymphocytes. These suppressive functions confer to TGF-β1 one of many cancer hallmarks with avoiding immune destruction.

Pancreatic ductal adenocarcinoma (PDAC) is the most common malignancy of the pancreas with an extremely poor prognosis with a five-year survival rate of 7% and a median survival of less than 11 months. PDAC is highly refractory to all available antitumor pharmacological options. This is the result of the strong desmoplastic reaction associated with PDAC progression, displaying a strong activation of pancreatic stellate cells and formation of dense extracellular matrix that results in insufficient tumor perfusion and an impenetrable barrier to intravenously infused anticancer drugs or chemotherapeutic agents. TGF-β1 contributes to PDAC desmoplasia by enhancing the conversion of fibroblasts or endothelial cells into myofibroblasts also known as cancer-associated fibroblasts (CAFs). Aggressiveness is further amplified by infiltrated immune cells and fibroblasts in the tumor microenvironment, which can produce high levels of TGF-β. TGF-β induces proangiogenic factors such as vascular endothelial growth factor, allowing PDAC progression, invasion, and metastasis. The acyl-CoA synthetase long-chain 3 (ACSL3) was found to be upregulated in PDAC and correlates with increased fibrosis. The decreased PAI-1 secretion from tumor cells by Acsl3 knockout markedly reduces tumor fibrosis and tumor-infiltrating immunosuppressive cells, increases cytotoxic T cell infiltration in mice. This study also found that PAI-1 expression in PDAC positively correlates with markers of fibrosis and immunosuppression and predicts poor patient survival. Since PAI-1 is a key component of SASP and a mediator of cellular senescence and is regulated by TGF-β1, it is conceivable that TGF-β1 plays a role in this ACSL3-PAI-1 signaling axis mediating tumor-stroma cross-talk that promotes pancreatic cancer progression.

In fibrotic disease, excessive deposition of extracellular matrix (EMC) proteins compromises tissue integrity and interferes with normal organ function. Fibrosis can arise in any tissue that suffered chronic insults but most frequently observed in the kidneys, livers, lung, and heart. Fibrosis is primarily driven by inflammatory cytokines including the interleukins and members of the TGF-β superfamily. Many of these ligands are expressed by infiltrating inflammatory cells which are attracted to the damaged tissue. Overexpression of TGF-β1 induces fibrosis via activation of both canonical (SMAD-based) and non-canonical (non SMAD-based) signaling pathways, which result in activation of myofibroblasts, excessive production of ECM and inhibition of ECM degradation. Activation of SMAD 2/3 regulates the expression of several profibrotic genes including collagens (COL1A1, COL3A1, COL5A2, COL6A1, COL6A3, and COL7A1), PAI-1, various proteoglycans, integrins, connective tissue growth factor, and matrix metalloproteases. This results in excessive deposits of ECM that compromises the local tissue architecture.

Although signaling through the SMAD pathway is believed to play a central role in TGF-β's fibrogenesis, emerging evidence indicates that reactive oxygen species (ROS) are also involved in modulating TGF-β's signaling through different pathways including the SMAD pathway. TGF-β1 increases mitochondrial ROS production in different type of cells, which mediate TGF-β-induced cell apoptosis, senescence, EMT, fibrotic gene expression and myofibroblast differentiation. TGF-β has been shown to induce the expression of several NADPH oxidases (Noxs) enzymes (including Nox1, Nox2, and Nox 4 in different types of cells), which are a group of heme-containing transmembrane proteins important in ROS production for both phagocytic and non-phagocytic cell. Nox4-derived ROS mediate TGF-β's fibrogenic effects, including fibroblast activation/myofibroblast differentiation, epithelial and endothelial cell apoptosis, EMT, and the expression of fibroblastic/profibrotic genes. An increase in Nox4 expression has also been detected in fibrotic diseases including IPF, which correlates with increased expression of myofibroblast marker, α-SMA, further supporting the role of Nox4 in fibrotic diseases. Several pathways have been shown to be involved in the induction of Nox4 by TGF-β. These include the SMAD pathway, PI3K pathway, MAPK pathways, and RHOA/ROCK pathway.

Emerging evidence suggests that there is crosstalk between mitochondria and NADPH oxidases. Mitochondria-derived ROS contribute to the increase in NOX expression in response to TGF-β whereas NOX-generated ROS cause mitochondria dysfunction and increase mitochondrial ROS production. The cross-talk between mitochondria and Nox enzyme has also been shown to mediate TGF-β's profibrogenic effect. A feed-forward interaction between mitochondria and Nox4 in TGF-β-induced ROS production is implicated (Jain et al., *Journal of Biological Chemistry*. 288:770-777, 2013).

By 2030, more than 20% of the population will be age 65 or older (see, census.gov/content/dam/Census/library/publications/2014/demo/p23-212.pdf) and approximately 40% will be obese (Finkelstein et al., *Am. J. Prev. Med.* 42(6): 563-570, 2012). Metabolic diseases impact the capacity of the cell to conduct vital processes that involve transport or processing of proteins, carbohydrates and lipids. Aging and obesity are key risk factors for chronic conditions that predispose to conditions including diabetes, cardiovascular disease and hepatic steatosis, all of which are leading causes of death and therefore pose a significant public health concern (Must et al., "The Disease Burden Associated with Overweight and Obesity," In: Feingold K R, Anawalt B., Boyce A., et al., eds., *Endotext*, South Dartmouth (MA), 2000; Martin et al., *Nat. Rev. Cardiol.* 14(3):132, 2017).

Excessive calorie intake promoted oxidative stress in adipose tissue in mice and resulted in features of Type-2 diabetes concomitantly with the expression of senescence markers such as p53, beta galactosidase in mice (Minamino et al., *Nat. Med.* 15(9):1082-1087, 2009). Senescence also promoted biological decline in adipose tissue by preventing adipogenic differentiation (Mitterberger et al., *Gerontol. A Biol. Sci.* 69(1):13-24, 2014). Another recent study has shown that obesity-induced senescence can lead to anxiety and impaired neurogenesis by increasing fat deposits in the brain and clearance of these senescent cells led to improvement in obesity-induced anxiety-like behavior in mice (Ogrodnik et al., *Cell Metab.* 29(5):1061-1077, 2019). Other studies have shown that obesity also impairs functions of immune cells. NK cell effector function was shown to be impaired due to lipid accumulation in these cells and reversal of this process restored function (Michelet et al., *Nat. Immunol.* 19(12):1330-1340, 2018). Additional studies have shown that impairment of NK cells in obesity is independent of age as similar defects were observed in young and older obese individuals (Tobin et al., *JCI Insight* 2(24):e94939, 2017; Michelet et al., *Nat. Immunol.* 19(12):1330-1340, 2018).

In mice, increased calorie intake leads to fat deposition in blood vessels which in turn recruit monocytes that engulf these lipids and turn into foamy macrophages that eventually accumulate in the subendothelial spaces leading to atherosclerotic plaques (Bennett et al., *Nat. Rev. Cardiol.* 14(3): 132, 2017; Katsuumi et al., *Front. Cardiovasc. Med.* 5:18, 2018). Mice fed on Western high fat diet (diet consisting of 42% calories from fat) also showed that the burden of senescent cells were directly proportional to the formation of plaques (lipid laden macrophages). Successful elimination of these senescent cells in transgenic mice led to significant reduction in plaque formation (Childs et al., *Science* 354 (6311):472-477, 2016).

Age, obesity and other factors linked to alterations in glucose levels, growth hormone (IGF) can lead to diabetes (Palmer et al., *Diabetes* 64(7):2289-2298, 2015). Upregulation of senescent markers like p53 in mice fed with high fat diet correlated with insulin resistance whereas inhibition of p53 activity in adipose tissue led to decrease in senescence markers and correlated with improved insulin resistance in mice models (Minamino et al., *Nat. Med.* 15(9):1082-1087, 2009). Concomitantly, pancreatic β-cell senescence has been shown to be a contributor to type 2 diabetes in obese mice (Sone et al., *Diabetologia* 48(1):58-67, 2005).

The hypothalamic production of TGF-β is excessive under high-fat diet conditions. This leads to hypothalamic inflammation, hyperglycemia, and glucose intolerance. The data suggest that the excessive amount of TGF-β induces a hypothalamic RNA stress response, leading to the accelerated mRNA decay of IκBα. IκBα is an inhibitor of NF-κB (Yan et al., *Nature Medicine* 20:1001-1008, 2014). Thus, TGF-β signaling exacerbates obesity and diabetes through actions on the peripheral and central nervous systems.

Aging is a major risk factor for developing many neurodegenerative diseases. Accumulation of senescent cells in the nervous system has been shown with aging and neurodegenerative disease and may predispose a person to the appearance of a neurodegenerative condition or may aggravate its course (Kritsilis et al., *Int. J. Mol. Sci.* 19(10:2937, 2018). Cellular senescence can impede cellular function by: 1. Promotion of chronic inflammation (Huell et al., *Acta Neuropathol.* 89(6):544-551, 1995; Nelson et al., *Aging Cell* 11(2):345-349, 2012), 2. Exhaustion of neuron regeneration (Cipriani et al., *Cereb. Cortex* 28(7):2458-2478, 2018), 3. Loss of function (De Stefano et al., *J. Neurol. Neurosurg. Psychiatry* 87(1):93-99, 2016) and 4. Blood brain barrier dysfunction (Yamazaki et al., *Stroke* 47(4):1068-1077, 2016). Studies have shown the accumulation of Aβ peptide containing amyloid plaques and misfolded tau protein in Alzheimer's disease (AD), the most prevalent neurodegenerative disease in humans (Musi et al., *Aging Cell* 17(6): e12840, 2018). These changes eventually affect neurons leading to cognitive impairment and neurodegeneration. Astrocytes cultured from AD patients showed high expression of well known senescent markers CDKi p16INK4A and MMP-1 and IL-6 (Bhat et al., *PLoS One* 7(9):e45069, 2012; Myung et al., *Age* 30(4):209-215, 2008). Clinical trials targeting amyloid proteins have been disappointing (Mehta et al., *Expert Opin. Invest. Drugs* 26(6):735-739, 2017). Recent studies have shown the presence of senescent cells to be responsible for neuronal disorders in animal models (Crews et al., *Hum. Mol. Genet.* 19(R1):R12-R20, 2010; Chinta et al., *Cell Rep.* 22(4):930-940, 2018). Studies in animal models reflecting human AD has shown encouraging results. Clearance of senescent cells in transgenic mice prevented neurofibrillary tangles and abnormal accumulations of a tau protein inside neurons thus preserving cognitive function (Bussian et al., *Nature* 562(7728):578-582, 2018). Patients with Parkinson's disease (PD), the second most common neurodegenerative disease demonstrate loss of motor control due to loss of dopamine-producing neurons in the substantia nigra. Astrocytes, the most abundant cell type within the CNS is important for providing structural, metabolic support to neurons and also plays a role in control of the blood brain barrier and blood flow. A recent groundbreaking study showed a senescent phenotype in astrocytes in postmortem brain samples from patients with PD (Chinta et al., *Cell Rep.* 22(4):930-940, 2018). This study also developed an animal model of PD induced by an environmental neurotoxin (Parquat, which induces senescence through oxidative stress) which showed neuropathology linked to PD. The authors showed that elimination of senescent cells in the transgenic mice lead to abrogation of paraquat-induced neuropathology.

Aging of the human skin can be either: 1. intrinsic (chronological), which is a consequence of physiologic and genetic changes over time or 2. extrinsic; caused by exposure to external factors such as ultraviolet (UV) radiation, environmental toxins and other agents that can induce DNA damage (Cavinato et al., *Exp. Gerontol.* 94:78-82, 2017). Among the changes that affect cutaneous tissue with age, the loss of elastic properties caused by changes in elastin production, increased degradation and/or processing produces a substantial impact on tissue esthetics and health (Wang et al., *Front. Genet.* 9:247, 2018). Acute UV exposure leads to sunburns, aberrant pigmentation, visible appearance of blood vessels under the skin (telangiectasia) and immune suppression while long term exposure may lead to premature skin aging and even risk of developing malignancies (Rittie et al., *Cold Spring Harb. Perspective* 5(1):a015370, 2015). There is a direct correlation between the evolution of medicine and population growth, which is characterized by an increase in the number of middle-aged and elderly individuals and therefore a significant demand for anti-aging treatments (Weihermann et al., *Int. J. Cosmet. Sci.* 39(3): 241-247, 2017). UVB from sunlight is mutagenic and directly induces DNA damage during DNA replication. The hallmark of photodamaged skin is accumulation of amorphous elastic fibers along with disorganized dermal collagen. Studies have shown that this could result from either impaired elastic and fibrillin production or elevated breakdown of Matrix metalloproteinases (MMP) secreted by senescent cells that have undergone DNA damage (Pittayapruek et al., *Int. J. Mol. Sci.* 17(6):868, 2016). Reactive oxygen species (ROS) production following UVB radiation leads to activation of factors central to senescence such as nuclear factor-kappa (NF-κB) and mitogen-activated protein kinase (MAPK) (Pittayapruek et al., *Int. J. Mol. Sci.* 17(6): 868, 2016). UVB irradiation can alter TGF-β signaling pathway in human dermal fibroblasts mainly by decreasing the synthesis of transforming growth factor-β receptor II (TβRII) (Purohit et al., *J. Dermatol.* 83(1):80-83, 2016). Several studies have shown the presence of senescent cells in aged as well as skin exposed to UV both in vitro and in vivo. Keratinocytes and skin fibroblasts have been extensively studied as models of photoaging which express markers of senescence such as $p16^{INK4asd}$, beta galactosidase, Lamin B1 and Senescence associated secretory phenotype (SASP) (Waaijer et al., *Aging* 10(2):278-289, 2018; Dimri et al., *Proc. Natl. Acad. Sci. U.S.A.* 92(20):9363-9367, 1995; Wang et al., *Sci. Rep.* 7(1):15678, 2017; Ghosh et al., *J. Invest. Dermatol.* 136(11):2133-2139, 2016). As senescent cells are known to express NK ligands, induction of NK cells along with activation of other immune cells (T regulatory cells) would represent an attractive strategy to clear senescent cells and maintain healthy skin (Carr et al., *Clin. Immunol.* 105(2):126-140, 2002; Ali et al., *Immunology* 152(3):372-381, 2017).

The confirmation that selectively killing senescent cells significantly improves the health span of mice in the context of normal aging and ameliorates the consequences of age-related disease or cancer therapy has ignited interest in the identification of compounds that can clear senescent cells. In nature, the senescent cells are normally removed by the innate immune cells. Induction of senescence not only prevents the potential proliferation and transformation of damaged/altered cells, but also favors tissue repair through the production of SASP factors (Munoz-Espin et al., *Nat. Rev. Mol. Cell Biol.* 15(7):482-496, 2014) that function as chemoattractants mainly for natural killer (NK) cells (such as IL-15 and CCL2) and macrophages (such as CFS-1 and CCL2). These innate immune cells mediate the immunosurveillance mechanism for eliminating stressed cells. Senescent cells usually up-regulate the NK-cell activating receptor NKG2D and DNAM1 ligands, which belong to a family of stress-inducible ligands, an important component of the frontline immune defense against infectious diseases and malignancies. Upon receptor activation, NK cells can then specifically induce the death of senescent cells through their cytolytic machinery. A role for NK cells in the immune surveillance of senescent cells has been pointed out in liver fibrosis (Sagiv et al., *Oncogene* 32(15):1971-1977, 2013), hepatocellular carcinoma (Iannello et al., *J. Exp. Med.* 210(10):2057-2069, 2013), multiple myeloma (Soriani et al., *Blood* 113(15):3503-3511, 2009), and glioma cells stressed by dysfunction of the mevalonate pathway (Ciaglia et al., *Int. J Cancer* 142(1):176-190, 2018). In cancer, combination chemotherapy was shown to upregulate markers of senescence and NK ligands on KRAS-mutant lung tumors suggesting that NK cells are required for targeting these cells (Ruscetti et al., *Science* 362(6421):1416-1422, 2018). Endometrial cells undergo acute cellular senescence and do not differentiate into decidual cells. The differentiated decidual cells secrete IL-15 and thereby recruit uterine NK cells to target and eliminate the undifferentiated senescent cells thus helping to re-model and rejuvenate the endometrium (Brighton et al., *Elife* 6, 2017). With a similar mechanism, during liver fibrosis, p53-expressing senescent liver satellite cells skewed the polarization of resident Kupfer macrophages and freshly infiltrated macrophages toward the pro-inflammatory M1 phenotype, which display senolytic activity. F4/80+ macrophages have been shown to play a key role in the clearance of mouse uterine senescent cells to maintain postpartum uterine function (Lujambio et al., *Cell* 153(2):449-460, 2013).

The strategies of senescent cell clearance mainly fall into three categories: senolytics, immunotherapy and SASP inhibition (He et al., *Cell* 169(6):1000-1011, 2017). There is a growing body evidence suggesting the efficacy of senolytics to clear senescent cells. Senolytics in general, act by targeting the senescent cell anti-apoptotic pathways (SCAP) like the BCL-2 protein family, the p53/p21$^{CIP1}$p21 axis, PI3K/AKT, receptor tyrosine kinases, and the HSP90 proteins. In mice, senolytics alleviate a range of conditions that have been associated with effects of senescent cells. So far, these include effects on cardiac, vascular, metabolic, neurological, radiation-induced, chemotherapy-induced, renal, and pulmonary functions as well as mobility and frailty in several animal models (Kirkland et al., *EBioMedicine* 21:21-28, 2017). A number of additional senolytic drugs are currently being developed. Recently, a FOXO4-related peptide that inhibits the PI3K/AKT/p53/p21 pathway was described and showed encouraging results both in vitro human fibroblast and mouse models. Other senolytics include ABT-737 and ABT-263 which act on BCL-2 protein (Tse et al., *Cancer Res.* 68(9):3421-3428, 2008) and A1331852 and A1155463 which target the BCL-XL pathway (Zhu et al., *Aging* (Albany NY) 9(3):955-963, 2017), dasatinib and quercitin which target tyrosine kinase have demonstrated senescent cell clearance (Farr et al., *Nat. Med.* 23(9):1072-1079, 2017). BCL-2 family inhibitors may potentially cause side effects like neutropenia and thrombocytopenia. As many of the senolytics are only in their pre-clinical phase, studies are warranted on possible side-effects before they move into clinical phase trials.

Blocking SASP factors is an alternative strategy to prevent the detrimental role of senescent cells. These factors include inflammatory chemokines and cytokines, growth factors, and matrix-remodeling proteases. The central pathways involved in these effects are the NF-κB and the C/EBPβ pathways. mTOR inhibitors, such as rapamycin and its analogs, can abolish SASP by reducing the expression of membrane-bound IL-1α. Two other notable drugs used to inhibit the NF-κB and the C/EBPβ pathways in vivo mouse models are Metformin and Ruxolitinib respectively (Moiseeva et al., *Aging Cell* 12(3):489-498, 2013; Xu et al., *Proc. Natl. Acad. Sci. U.S.A.* 112(46):E6301-6310, 2015). Other drugs like siltuximab or tocilizumab block cytokines like IL-6, another SASP factors. Again, as with the use of some senolytics, treatment with anti-inflammatory drugs can give rise to potential side effects (Karkera et al., *Prostate* 71(13): 1455-1465, 2011). A recent Phase I clinical trial using senolytics (dasatinib plus quercetin) in patients with pulmonary fibrosis did not lead to any conclusive results (Justice et al., *EBioMedicine* 40:554-563, 2019).

The third strategy, which is potentially superior than those described above is immune-mediated interventions. As mentioned above, cells recruited to clear senescent cells include NK cells, macrophages and neutrophils. Senescent cells recruit NK cells by mainly upregulating ligands to NKG2D (expressed on NK cells), chemokines and other SASP factors. In vivo models of liver fibrosis have shown effective clearance of senescent cells by activated NK cells (Krizhanovsky et al., *Cell* 134(4):657-667, 2008). Senescent cells resist NK cell mediated clearance by upregulating decoy receptor DCR2 which inhibits apoptosis and restricting their clearance mainly by granzyme and perforin mediated pathways (Sagiv et al., *Oncogene* 32(15):1971-1977, 2013). Recent data has shown that lipid accumulation in NK cells seen in obese individuals leads to reduction in both their frequencies and effector cytotoxic function and this was independent of age (Michelet et al., *Nat. Immunol.* 19(12): 1330-1340, 2018; Tobin et al., *JCI Insight* 2(24):e94939, 2017). NK cell-mediated antibody-dependent cell cytotoxicity (ADCC) has been demonstrated in vitro human senescent cells against dipeptidyl peptidase 4 (DPP4/CD26), a recently described senescence marker (Kim et al., *Genes Dev.* 31(15):1529-1534, 2017). Other strategies include using CAR-T cells to redirect immune responses against senescent cells (Grupp et al., *N. Engl. J. Med.* 368(16):1509-1518, 2013; Yousefzadeh et al., *Nature*, published online on May 12, 2021).

Studies have described various models to study senescence including liver fibrosis (Krizhanovsky et al., *Cell* 134(4):657-667, 2008), osteoarthritis (Xu et al., *J. Gerontol. A Biol. Sci. Med. Sci.* 72(6):780-785, 2017), Parkinson's (Chinta et al., *Cell Rep.* 22(4):930-940, 2018), obesity induced anxiety (Ogrodnik et al., *Cell Metab.* 29(5):1061-1077, 2019), atherosclerosis (Childs et al., *Science* 354 (6311):472-477, 2016), and diabetes (Sone et al., *Diabetologia* 48(1):58-67, 2005). One recent study showed that transplanting in-vitro senescence-induced cells into young mice led to physical dysfunction (Xu et al., *Nat. Med.* 24(8):1246-1256, 2018). The question that lingers is which type of therapy is effective in clearing senescent cells in different tissues. Majority of the available data are based on in vitro experiments and few mouse studies (Krizhanovsky et al., *Cell* 134(4):657-667, 2008; Xu et al., *Nat. Med.* 24(8):1246-1256, 2018; Baker et al., *Nature* 479(7372):232-236, 2011; Fan et al., *Nat. Med.* 23(9):1072-1079, 2017; Xu et al., *J. Gerontol. A Biol. Sci. Med. Sci.* 72(6):780-785, 2017; Bourgeois et al., *FEBS Lett.* 592(12):2083-2097, 2018). NK cells provide an attractive strategy to counter senescent cell accumulation. However, very few studies in senescence models have explored this strategy (Krizhanovsky et al., *Cell* 134(4):657-667, 2008). Various clinical trials have shown the success of utilizing adoptive transfer of NK cells to treat various forms of cancer (Sakamoto et al., *J. Transl. Med.* 13:277, 2015; Miller et al., *Blood* 105(8):3051-3057, 2005; Cifaldi et al., *Trends Mol. Med.* 23(12):1156-1175, 2017; Li et al., *Cytotherapy* 20(1):134-148, 2018). Of importance is the recent clinical trial of utilizing autologous ex-vivo expanded NK cells in patients with colon cancer (Li et al., *Cytotherapy* 20(1):134-148, 2018). The authors showed that NK cell therapy in combination with chemotherapy prevented recurrence and prolonged survival with acceptable adverse effects (Li et al., *Cytotherapy* 20(1):134-148, 2018). Transfer of cytokine activated-NK cells by cytokines such as IL-15, IL-12, IL-18 and IL-21 can be used as a potential immunotherapeutic strategy to clear senescent cells with minimal side-effects (Romee et al., *Blood* 120 (24): 4751-4760, 2012; Song et al., *Eur. J. Immunol.* 48(4): 670-682, 2018). Moreover, the safety of using NK cells has been shown in acute myeloid leukemia (Romee et al., *Blood* 120(24): 4751-4760, 2012; Fehniger et al., *Biol. Blood Marrow Transplant.* 2018). Other approaches would be to block circulating SASP factors like TGF-β, IL-8 and IL-6 (Ganesh et al., *Immunity* 48(4):626-628, 2018; Georgilis et al., *Cancer Cell* 34(1):85-102, 2018). The models of senescence mentioned above would be ideal to test these approaches. Therefore, more consideration should be given to such strategies that avoid unwanted side-effects from using foreign compounds and drugs as a solution to age-related pathologies.

Cellular senescence is a series of progressive and phenotypically diverse cellular states that are acquired after initial growth arrest (Van Deursen, *Nature* 509(7501): 439-446, 2014). Thus, senescent cells are heterogeneous populations of cells with few shared core properties (Dou et al., *Nature* 550(7676):402-406, 2017). Identifying common senolytic drug targets, therefore, is difficult. This further precludes the achievement of a goal of developing senolytics that selectively, safety, and effectively eliminate senescent cells upon systemic administration. As described above, immune cells are the effector cells to remove senescent cells naturally after the fulfillment of senescent-cell physiological roles (Brighton et al., *Elife* 6, 2017). The weakening of the immune system during the aging process allows the accumulation of senescent cells (Karin et al., *Nat Commun* 10(1):5495, 2019) (Chambers et al., *Allergy Clin Immunol* 145(5): 1323-1331, 2020). In addition, TGF-β, a component of the SASP of senescent cells, plays a caustic role in cellular senescence and aging-related pathologies when it is produced in an excessive amount in tissues (Tominaga et al., *Int. J. Mol. Sci.* 20(20), 2019). Provided herein are methods of using complexes of common gamma-chain cytokines and their cognate receptors to promote and to activate immune cells, and TGF-βRII to reduce the amount of the active form of TGF-β in the aging tissues and tumor microenvironment through subcutaneous administration to regain their capabilities of reducing senescent cells and to lower the chronic inflammation in vivo effectively, selectively, and safely.

In some embodiments of any of the methods described herein, the methods result in rejuvenation of aged immune cells in the subject (e.g., one or more of: increased metabolic activity (e.g., increased oxidative phosphorylation, increased glycolysis, and increased oxygen consumption) of aged immune cells in the subject; decreased level(s) of one or more of p16, p21, and a SASP factor in aged immune cells in the subject; and increased cytolytic activity of the aged immune cells in the subject, e.g., as compared to the level(s) in the subject prior to treatment). As used herein, the term "aged immune cell" means an immune cell that has one or more of: reduced metabolic activity (e.g., reduced oxidative phosphorylation, reduced glycolysis, and reduced oxygen consumption); increased level(s) of one or more of p16, p21, and a SASP factor; and decreased cytolytic activity, e.g., as compared to a control immune cell obtained from a healthy subject (non-immune compromised subject) whose age is less than half the average life span of the subject's population. Non-limiting examples of aged immune cells include aged NK cells, aged NKT cells, aged T cells, aged B cells, aged monocytes, aged macrophages, aged neutrophils, aged basophils, aged eosinophils, Kupffer cells, and aged microgial cells.

In some embodiments of any of the methods described herein, the methods result in an increase in the naïve T cell to memory T cell ratio in the subject. In some embodiments of any of the methods described herein, the methods result in a decrease in the ratio of $CD4^+$ T cells to $CD8^+$ T cells in the subject.

In some embodiments, the rejuvenation of the aged immune cells results in a reduction of number of diseased cells or infectious agents in the subject. In some embodiments, the aged immune cells include one or more of aged NK cells, aged NKT cells, aged T cells, aged B cells, aged monocytes, aged macrophages, aged neutrophils, aged basophils, aged eosinophils, aged Kupffer cells, and aged microgial cells. In some embodiments, the diseased cells include cancer cells, virally-infected cells, and intracellularly-bacterially-infected cells. In some embodiments, the infectious agents include virus, bacterium, fungus, and parasite.

Provided herein are also methods of using complexes of common gamma-chain cytokines and their cognate receptors and/or agents that result in a decrease in the activation of a TGF-β receptor to rejuvenate the immune system.

Methods of Improving the Texture and/or Appearance of Skin and/or Hair

Also provided herein are methods of improving the texture and/or appearance of skin and/or hair in a subject in need thereof over a period of time (e.g. any of the periods of time described herein) that include administering to the subject a therapeutically effective amount of one or more natural killer (NK) cell activating agent(s) (e.g. any of the NK cell activating agent(s) described herein or known in the art).

Also provided herein are methods of improving the texture and/or appearance of skin and/or hair in a subject in need thereof over a period of time (e.g. any of the periods of time described herein) that include administering to the subject a therapeutically effective number of activated NK cells (e.g. any of the activated NK cells described herein or known in the art).

Some embodiments of these methods further include: obtaining a resting NK cell; and contacting the resting NK cell in vitro in a liquid culture medium including one or more NK cell activating agent(s), where the contacting results in the generation of the activated NK cells that are subsequently administered to the subject. In some examples of these methods, the resting NK cell is an autologous NK cell obtained from the subject. In some examples of these methods, the resting NK cell is a haploidentical NK cell obtained from the subject. In some examples of these methods, the resting NK cell is an allogeneic resting NK cell. In some examples of these methods, the resting NK cell is an artificial NK cell. In some examples of any of these methods, the resting NK cell is a genetically-engineered NK cell carrying a chimeric antigen receptor or recombinant T cell receptor.

In some examples of these methods, the liquid culture medium is a serum-free liquid culture medium. In some embodiments of any of the methods described herein, the liquid culture medium is a chemically-defined liquid culture medium. Some examples of these methods further include isolating the activated NK cells (and further administering a therapeutically effective amount of the activated NK cells to a subject, e.g., any of the subjects described herein). In some embodiments of these methods, the contacting step is performed for a period of about 2 hours to about 20 days (or any of the subranges of this range described herein).

In some embodiments of these methods, the method provides for an improvement in the texture and/or appearance of skin of the subject over the period of time (e.g. any of periods of time described herein).

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the rate of formation of wrinkles in the skin of the subject over the period of time (e.g., any of the periods of time described herein), e.g., as compared to the rate of formulation of wrinkles in the subject prior to treatment or the rate of formulation of wrinkles in a similar subject not receiving a treatment.

In some embodiments of these methods, the method results in an improvement in the coloration of skin of the subject over the period of time (e.g. any of the periods of time described herein).

In some embodiments of these methods, the method results in an improvement in the texture of skin of the subject over the period of time (e.g. any of the periods of time described herein).

In some embodiments of these methods, the method provides for an improvement in the texture and/or appearance of hair of the subject over the period of time (e.g. any of the periods of time described herein).

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the rate of formation of gray hair in the subject over the period of time (e.g. any of the range of time period described herein), e.g., as compared to the rate of formulation of gray hair in the subject prior to treatment or the rate of formulation of gray hair in a similar subject not receiving a treatment.

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the number of gray hairs of the subject over the period of time (e.g. any of the periods of time described herein), e.g., as compared to the number of gray hairs in the subject prior to treatment or the rate of formation of gray hairs in a similar subject not receiving a treatment.

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the rate of hair loss in the subject over the period of time (e.g., any of the periods of time described herein), e.g., as compared to the rate of hair loss in the subject prior to treatment or the rate of hair loss in a similar subject not receiving a treatment.

In some embodiments of these methods, the method results in an improvement in the texture of hair of the subject over the period of time (e.g. any of the periods of time described herein).

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the number of senescent dermal fibroblasts in the skin of the subject over the period of time (e.g., any of the periods of time described herein), e.g., as compared to the number of senescent dermal cells in the subject prior to treatment or the number of senescent dermal cells in a similar subject not receiving a treatment.

In some embodiments of these methods, improvement in the texture and/or appearance of skin of the subject over the period of time (e.g. any of the periods of time described herein) can be assessed by any method described herein or known in the art, including inspecting the presence, size and shape of skin lesions, skin color and pigmentation, skin moisture, temperature, elasticity, and vascularity.

In some embodiments of these methods, improvement in the texture and/or appearance of hair of the subject over the period of time (e.g., any of periods of time described herein) can be assessed by any method described herein or known in the art, In some embodiments of these methods, the period of time is, e.g., one month to ten years, one month to nine years, one month to eight years, one month to seven years, one month to six years, one month to five years, one month to four years, one month to three years, one month to two years, one month to eighteen months, one month to twelve months, one month to ten months, one month to eight months, one month to six months, one month to four months, one month to two months, one month to six weeks, six weeks to ten years, six weeks to nine years, six weeks to eight years, six weeks to seven years, six weeks to six years, six weeks to five years, six weeks to four years, six weeks to three years, six weeks to two years, six weeks to eighteen months, six weeks to twelve months, six weeks to ten months, six weeks to eight months, six weeks to six months, six weeks to four months, six weeks to two months, two months to ten years, two months to nine years, two months to eight years, two months to seven years, two months to six years, two months to five years, two months to four years, two months to three years, two months to two years, two months to eighteen months, two months to twelve months, two months to ten months, two months to eight months, two months to six months, two months to four months, four months to ten years, four months to nine years, four months to eight years, four months to seven years, four months to six years, four months to five years, four months to four years, four months to three years, four months to two years, four months to eighteen months, four months to twelve months, four months to ten months, four months to eight months, four months to six months, six months to ten years, six months to nine years, six months to eight years, six months to seven years, six months to six years, six months to five years, six months to four years, six months to three years, six months to two years, six months to eighteen months, six months to twelve months, six months to ten months, six months to eight months, eight months to ten years, eight months to nine years, eight months to eight years, eight months to seven years, eight months to six years, eight months to five years, eight months to four years, eight months to three years, eight months to two years, months to eighteen months, eight months to twelve months, eight months to ten months, ten months to ten years, ten months to nine years, ten months to eight years, ten months to seven years, ten months to six years, ten months to five years, ten months to four years, ten months to three years, ten months to two years, ten months to eighteen months, ten months to twelve months, twelve months to ten years, twelve months to nine years, twelve months to eight years, twelve months to seven years, twelve months to six years, twelve months to five years, twelve months to four years, twelve months to three years, twelve months to two years, twelve months to eighteen months, eighteen months to ten years, eighteen months to nine years, eighteen months to eight years, eighteen months to seven years, eighteen months to six years, eighteen months to five years, eighteen months to four years, eighteen months to three years, eighteen months to two years, two years to ten years, two years to nine years, two years to eight years, two years to seven years, two years to six years, two years to five years, two years to four years, two years to three years, three years to ten years, three years to nine years, three years to eight years, three years to seven years, three years to six years, three years to five years, three years to four years, four years to ten years, four years to nine years, four years to eight years, four years to seven years, four years to six years, four years to five years, five years to ten years, five years to nine years, five years to eight years, five years to seven years, five years to six years, six years to ten years, six years to nine years, six years to eight years, six years to seven years, seven years to ten years, seven years to nine years, seven years to eight years, eight years to ten years, eight years to nine years, or nine years to ten years.

In some embodiments of these methods, the age of the subject is between about 30 to about 35, about 35 to about 40, about 40 to about 45, about 45 to about 50, about 50 to about 55, about 55 to about 60, about 60 to about 65, about 65 to about 70, about 70 to about 75, about 75 to about 80, about 80 to about 85, about 85 to about 90, about 90 to about 95, about 95 to about 100, about 100 to about 105, about 105 to about 110, about 110 to about 115, or about 115 to about 120.

Methods of Assisting in the Treatment of Obesity in a Subject

Provided herein are methods of assisting in the treatment of obesity in a subject in need thereof over a period of time (e.g. any of the range of time period described herein), that include administering to the subject a therapeutically effective amount of one or more natural killer (NK) cell activating agent(s) (e.g. any of the NK cell activating agent(s) described herein or known in the art).

Also provided herein are methods of assisting in the treatment of obesity in a subject in need thereof over a period of time (e.g. any of the range of time period described herein) that include administering to the subject a therapeutically effective number of activated NK cells (e.g. any of the activated NK cells described herein or known in the art).

Some embodiments of these methods further include: obtaining a resting NK cell; and contacting the resting NK cell in vitro in a liquid culture medium including one or more NK cell activating agent(s), where the contacting results in the generation of the activated NK cells that are subsequently administered to the subject. In some examples of these methods, the resting NK cell is an autologous NK cell obtained from the subject. In some examples of these methods, the resting NK cell is a haploidentical NK cell obtained from the subject. In some examples of these methods, the resting NK cell is an allogeneic resting NK cell. In some examples of these methods, the resting NK cell is an artificial NK cell. In some examples of any of these methods, the resting NK cell is a genetically-engineered NK cell carrying a chimeric antigen receptor or recombinant T cell receptor.

In some examples of these methods, the liquid culture medium is a serum-free liquid culture medium. In some embodiments of any of the methods described herein, the liquid culture medium is a chemically-defined liquid culture medium. Some examples of these methods further include isolating the activated NK cells (and further administering a therapeutically effective amount of the activated NK cells to a subject, e.g., any of the subjects described herein). In some embodiments of these methods, the contacting step is performed for a period of about 2 hours to about 20 days (or any of the subranges of this range described herein).

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the mass of the subject over the period of time (e.g. any of the periods of time described herein), e.g., as compared to the mass of the subject prior to treatment.

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the body mass index (BMI) of the subject over the period of time (e.g. any of periods of time described herein), e.g., as compared to the BMI of the subject prior to treatment.

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the rate of progression from pre-diabetes to type 2 diabetes in the subject, e.g., as compared to the rate of progression from pre-diabetes to type 2 diabetes in the subject prior to treatment or the rate of progression from pre-diabetes to type 2 diabetes in a similar subject not receiving a treatment.

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in fasting serum glucose level in the subject, e.g., as compared to the fasting serum glucose level in the subject prior to treatment.

In some embodiments of these methods, the method results in an increase (e.g., at least a 5% increase, at least a 10% increase, at least a 15% increase, at least a 20% increase, at least a 25% increase, at least a 30% increase, at least a 35% increase, at least a 40% increase, at least a 45% increase, at least a 50% increase, at least a 55% increase, at least a 60% increase, at least a 65% increase, at least a 70% increase, at least a 75% increase, at least a 80% increase, at least a 85% increase, at least a 90% increase, at least a 95% increase, or at least a 99% increase, or about a 10% increase to about a 500% increase (or any of the subranges of this range described herein) in insulin sensitivity in the subject, e.g., as compared to the insulin sensitivity in the subject prior to treatment.

In some embodiments of these methods, the method results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the severity of atherosclerosis in the subject, e.g., as compared to the severity of atherosclerosis in the subject prior to treatment.

In some embodiments of these methods, treatment of obesity in the subject over the period of time (e.g. any of the periods of time described herein) can be assessed by any method described herein or known in the art, including, e.g., measurement of body weight and/or body dimensions, total body fat, total or regional adiposity, and body mass index (BMI).

In some embodiments of these methods, the response of a subject to the treatment can be monitored by determining fasting serum glucose level or glucose tolerance according to standard techniques. In some embodiments of these methods, insulin sensitivity can be measured using any method described herein or known in the art, including hyperinsulinemic euglycemic clamp and intravenous glucose tolerance test, homeostasis model assessment (HOMA), and quantitative insulin sensitivity check index (QUICKI).

In some embodiments of these methods, the severity of atherosclerosis in the subject can be measured using any method described herein or known in the art, including cardiac catheterization, Doppler sonography, blood pressure comparison, MUGA/radionuclide angiography, Thallium/myocardial perfusion scan, and computerized tomography.

In some embodiments of these methods, the period of time is one month to ten years (or any of the subranges of this range described herein).

In some embodiments of these methods, the age range for the subject is between about 1 to about 5, about 5 to about 10, about 10 to about 15, about 15 to about 20, about 20 to about 25, about 25 to about 30, about 30 to about 35, about 35 to about 40, about 40 to about 45, about 45 to about 50, about 50 to about 55, about 55 to about 60, about 60 to about 65, about 65 to about 70, about 70 to about 75, about 75 to about 80, about 80 to about 85, about 85 to about 90, about 90 to about 95, about 95 to about 100, about 100 to about 105, about 105 to about 110, about 110 to about 115, or about 115 to about 120.

Additional Therapeutic Agents

Some embodiments of any of the methods described herein can further include administering to a subject (e.g., any of the subjects described herein) a therapeutically effective amount of one or more additional therapeutic agents. The one or more additional therapeutic agents can be administered to the subject at substantially the same time as the NK cell activating agent(s) or activated NK cells (e.g., administered as a single formulation or two or more formulations to the subject). In some embodiments, one or more additional therapeutic agents can be administered to the subject prior to administration of the NK cell activating agent(s) or activated NK cells. In some embodiments, one or more additional therapeutic agents can be administered to the subject after administration of the NK cell activating agent(s) or activated NK cells to the subject.

Non-limiting examples of additional therapeutic agents include: anti-cancer drugs, activating receptor agonists, immune checkpoint inhibitors, agents for blocking HLA-specific inhibitory receptors, Glucogen Synthase Kinase (GSK) 3 inhibitors, and antibodies.

Non-limiting examples of anticancer drugs include antimetabolic drugs (e.g., 5-fluorouracil (5-FU), 6-mercaptopurine (6-MP), capecitabine, cytarabine, floxuridine, fludarabine, gemcitabine, hydroxycarbamide, methotrexate, 6-thioguanine, cladribine, nelarabine, pentostatin, or pemetrexed), plant alkaloids (e.g., vinblastine, vincristine, vindesine, camptothecin, 9-methoxycamptothecin, coronaridine, taxol, naucleaorals, diprenylated indole alkaloid, montamine, schischkiniin, protoberberine, berberine, sanguinarine, chelerythrine, chelidonine, liriodenine, clivorine, β-carboline, antofine, tylophorine, cryptolepine, neocryptolepine, corynoline, sampangine, carbazole, crinamine, montanine, ellipticine, paclitaxel, docetaxel, etoposide, tenisopide, irinotecan, topotecan, or acridone alkaloids), proteasome inhibitors (e.g., lactacystin, disulfiram, epigallocatechin-3-gallate, marizomib (salinosporamide A), oprozomib (ONX-0912), delanzomib (CEP-18770), epoxomicin, MG132, beta-hydroxy beta-methylbutyrate, bortezomib, carfilzomib, or ixazomib), antitumor antibiotics (e.g., doxorubicin, daunorubicin, epirubicin, mitoxantrone, idarubicin, actinomycin, plicamycin, mitomycin, or bleomycin), histone deacetylase inhibitors (e.g., vorinostat, panobinostat, belinostat, givinostat, abexinostat, depsipeptide, entinostat, phenyl butyrate, valproic acid, trichostatin A, dacinostat, mocetinostat, pracinostat, nicotinamide, cambinol, tenovin 1, tenovin 6, sirtinol, ricolinostat, tefinostat, kevetrin, quisinostat, resminostat, tacedinaline, chidamide, or selisistat), tyrosine kinase inhibitors (e.g., axitinib, dasatinib, encorafinib, erlotinib, imatinib, nilotinib, pazopanib, and sunitinib), and chemotherapeutic agents (e.g., all-trans retinoic acid, azacitidine, azathioprine, doxifluridine, epothilone, hydroxyurea, imatinib, teniposide, tioguanine, valrubicin, vemurafenib, and lenalidomide). Additional examples of chemotherapeutic agents include alkylating agents, e.g., mechlorethamine, cyclophosphamide, chlorambucil, melphalan, ifosfamide, thiotepa, hexamethylmelamine, busulfan, altretamine, procarbazine, dacarbazine, temozolomide, carmustine, lumustine, streptozocin, carboplatin, cisplatin, and oxaliplatin.

Non-limiting examples of activating receptor agonists include any agonists for activating receptors which activate and enhance the cytotoxicity of NK cells, including anti-CD16 antibodies (e.g., anti-CD16/CD30 bispecific monoclonal antibody (BiMAb)) and Fc-based fusion proteins. Non-limiting examples of checkpoint inhibitors include anti-PD-1 antibodies (e.g., MEDI0680), anti-PD-L1 antibodies (e.g., BCD-135, BGB-A333, CBT-502, CK-301, CS1001, FAZ053, KN035, MDX-1105, MSB2311, SHR-1316, anti-PD-L1/CTLA-4 bispecific antibody KN046, anti-PD-L1/TGFβRII fusion protein M7824, anti-PD-L1/TIM-3 bispecific antibody LY3415244, atezolizumab, or avelumab), anti-TIM3 antibodies (e.g., TSR-022, Sym023, or MBG453) and anti-CTLA-4 antibodies (e.g., AGEN1884, MK-1308, or an anti-CTLA-4/OX40 bispecific antibody ATOR-1015). Non-limiting examples of agents for blocking HLA-specific inhibitory receptors include monalizumab (e.g., an anti-HLA-E NKG2A inhibitory receptor monoclonal antibody). Non-limiting examples of GSK3 inhibitor include tideglusib or CHIR99021. Non-limiting examples of antibodies that can be used as additional therapeutic agents include anti-CD26 antibodies (e.g., YS110), anti-CD36 antibodies, and any other antibody or antibody construct that can bind to and activate an Fc receptor (e.g., CD16) on a NK cell. In some embodiments, an additional therapeutic agent can be insulin or metformin.

Exemplary Methods that Include Administration of One or More Common Gamma-Chain Family Cytokine Receptor Activating Agent(s)

Provided herein are methods of killing or reducing the number of naturally-occurring and/or treatment-induced senescent cells in a subject that include administering to the subject a therapeutically effectively amount of one or more common gamma-chain family cytokine receptor activating agent(s).

Also provided herein are methods of decreasing the accumulation of naturally-occurring and/or treatment-induced senescent cells in a subject that include administering to the subject a therapeutically effectively amount of one or more common gamma-chain family cytokine receptor activating agent(s).

Also provided herein are methods of decreasing a level of a marker of naturally-occurring and/or treatment-induced senescent cells in a subject that include administering to the subject a therapeutically effective amount of one or more common gamma-chain family cytokine receptor activating agent(s). In some embodiments, a marker of naturally-occurring and/or treatment-induced senescent cells is $p21^{CIP1}$p21 and CD26. Additional markers of naturally-occurring and/or treatment-induced senescent cells are described herein. Additional markers of naturally-occurring and/or treatment-induced senescent cells are known in the art.

Also provided herein are methods of reducing the activity of naturally-occurring and/or treatment-induced senescent cells in a subject that include administering to the subject a therapeutically effective amount of one or more common gamma-chain family cytokine receptor activating agent(s).

Also provided herein are methods of decreasing levels and/or activity of one or more senescence-associated secretory phenotype (SASP) factor(s) derived from naturally-occurring and/or treatment-induced senescent cells in a subject that include administering to the subject a therapeutically effective amount of one or more common gamma-chain family cytokine receptor activating agent(s). In some embodiments, senescent cells express an inflammatory signature, where the inflammatory signature is aSASP factor. In some embodiments, the senescence-associated secretory phenotype (SASP) factor includes, but is not limited to, inflammatory cytokines (e.g., IL-1α, IL-1β, IL-6, IL-8, and TNF-α), growth factors (e.g., TGF-β, PDGF-AA, and insulin-like growth factor-binding proteins (IGFBPs)), chemokines (e.g., CCL-2, CCL-20, CCL-7, CXCL-4, CXCL1, and CXCL-12), and matrix metalloproteinases (e.g., MMP-3, MMP-9) that operate in a cell-autonomous manner to reinforce senescence (autocrine effects) and communicate with and modify the microenvironment (paracrine effects). In some embodiments, the method decreases expression levels and/or activity of one or more (e.g., two, three, four, or five) of the senescence-associated secretory phenotype (SASP) factor(s). In some embodiments, the expression level or activity of a SASP factor is determined using enzyme-linked immunosorbent assay (ELISA). In some embodiments, the expression level or activity of a SASP factor is determined using immunoblotting.

In some embodiments of any of the methods described herein, the subject has been previously diagnosed or identified as having an aging-related disease (e.g. any of the exemplary types of aging-related disease or condition described herein or known in the art) or an inflammatory disease (e.g. any of the exemplary types of aging-related disease or condition described herein or known in the art).

In some embodiments, the aging-related disease is inflamm-aging related.

In some embodiments, the aging-related disease is a cancer (e.g. any of the exemplary types of cancer described herein or known in the art).

In some embodiments of any of the methods described herein, the inflammatory disease is selected from the group consisting of: rheumatoid arthritis, inflammatory bowel disease, lupus erythematosus, lupus nephritis, diabetic nephropathy, CNS injury, Alzheimer's disease, Parkinson's disease, amyotrophic lateral sclerosis, Crohn's disease, multiple sclerosis, Guillain-Barre syndrome, psoriasis, Grave's disease, ulcerative colitis, nonalcoholic steatohepatitis, mood disorders and cancer treatment-related cognitive impairment.

In some examples of these methods, the treatment-induced senescent cells are chemotherapy-induced senescent cells.

In some embodiments of these methods, the administering results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the number of naturally-occurring and/or treatment-induced senescent cells in a target tissue (e.g., any of the exemplary types of target tissues described herein or known in the art) in the subject, e.g., as compared to the number of naturally-occurring and/or treatment-induced senescent cells in the target tissue in the subject prior to treatment.

In some embodiments of these methods, the administering results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the accumulation of naturally-occurring and/or treatment-induced senescent cells in the subject (e.g., any of the periods of time described herein), e.g., as compared to the accumulation of naturally-occurring and/or treatment-induced senescent cells in the subject prior to treatment or the accumulation of naturally-occurring and/or treatment-induced senescent cells in a similar subject not receiving a treatment.

In some embodiments of these methods, the administering results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in a level of one or more (e.g., two, three, or four) marker(s) of naturally-occurring and/or treatment-induced senescent cells in the subject, e.g., as compared to the level of the one or more marker(s) of naturally-occurring and/or treatment-induced senescent cells in the subject prior to treatment.

"Naturally-occurring senescent cells" as described herein are senescent cells that are generated as a result of normal aging or inflammatory processes. Naturally-occurring senescent cells may accumulate in various tissues and organs of an individual over time. Naturally-occurring senescent cells can be any of the exemplary types of senescent cells described herein that are not induced by a therapeutic treatment (e.g., chemotherapy or radiation).

"Treatment-induced senescent cells" as described herein are senescent cells that are generated as a result of therapeutic treatment (e.g., chemotherapy or radiation).

Common Gamma-Chain Family Cytokine Receptor Activating Agents

Provided herein are methods that include the use or administration of one or more common gamma-chain family cytokine receptor activating agent(s). In some embodiments, the common gamma-chain family cytokine receptor activating agent is a single-chain chimeric polypeptide (e.g. any of the exemplary single-chain chimeric polypeptides described herein), a multi-chain chimeric polypeptide (e.g. any of the exemplary multi-chain chimeric polypeptides described herein), a soluble IL-15 or IL-15 agonist (e.g., any of the soluble IL-15 or IL-15 agonists described herein), a soluble IL-2 or IL-2 agonist (e.g., any of the soluble IL-2 or IL-2 agonists described herein), a complex of a common gamma-chain family cytokine (or a functional fragment thereof) and an antibody (or antibody fragment) that binds specifically to the common gamma-chain family cytokine or the functional fragment thereof, an antibody or an antigen-binding antibody fragment that binds specifically to a common gamma-chain family cytokine.

Exemplary Single-Chain Chimeric Polypeptide

Non-limiting examples of common gamma-chain family cytokine receptor activating agents are single-chain chimeric polypeptides that include: (i) a first target-binding domain, (ii) a soluble tissue factor domain (e.g., any of the exemplary soluble tissue factor domains described herein or known in the art), and (iii) as second target-binding domain, wherein one or both of the first target-binding domain and the second target-binding domain is a soluble common gamma-chain family cytokine, an agonistic antigen-binding domain that binds specifically to a common gamma-chain family cytokine receptor, a soluble common gamma-chain family cytokine receptor, or an antigen-binding domain that binds specifically to a common gamma-chain family cytokine.

Some embodiments of any of the single-chain chimeric polypeptides described herein can further include one or more (e.g., two, three, four, five, six, seven, eight, nine, or ten) additional target-binding domains (e.g., any of the exemplary target-binding domains described herein or known in the art) at its N- and/or C-terminus.

In some embodiments of any of the single-chain chimeric polypeptide described herein, one or more of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is a soluble common gamma-chain family cytokine. Non-limiting examples of soluble common gamma-chain family cytokines include soluble IL-2, soluble IL-4, soluble IL-7, soluble IL-9, soluble IL-15, and soluble IL-21.

In some embodiments, one or both of the first target-binding domain and the second target-binding domain includes a soluble common gamma-chain family cytokine receptor (e.g., a soluble receptor for IL-2, IL-4, IL-7, IL-9, IL-15, and IL-21).

In some embodiments of any of the single-chain chimeric polypeptides described herein, one or more of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is an agonistic antigen-binding domain that binds specifically to a common gamma-chain family cytokine receptor. Non-limiting examples of common gamma-chain family cytokine receptors include a receptor for one or more of IL-2, IL-4, IL-7, IL-9, IL-15, and IL-21.

Multi-Chain Chimeric Polypeptide

Non-limiting examples of common gamma-chain family cytokine receptor activating agents are multi-chain chimeric polypeptides that include: (a) a first chimeric polypeptide including: (i) a first target-binding domain; (ii) a soluble tissue factor domain; and (iii) a first domain of a pair of affinity domains; and (b) a second chimeric polypeptide including: (i) a second domain of a pair of affinity domains; and (ii) a second target-binding domain, where one or both of the first target-binding domain and the second target-binding domain is a soluble common gamma-chain family cytokine, an agonistic antigen-binding domain that binds specifically to a common gamma-chain family cytokine receptor, a soluble common gamma-chain family cytokine receptor, or an antigen-binding domain that binds specifically to a common gamma-chain family cytokine.

In some embodiments of any of the multi-chain chimeric polypeptides, the first chimeric polypeptide further includes one or more (e.g., two, three, four, five, six, seven, eight, nine, or ten) additional target-binding domain(s) (e.g., any of the exemplary target-binding domains described herein or known in the art).

In some embodiments of any of the multi-chain chimeric polypeptides described herein, one or more (e.g., two, three, four, five, six, seven, eight, nine, or ten) of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is a soluble common gamma-chain family cytokine. Non-limiting examples of soluble common gamma-chain family cytokines include soluble IL-2, soluble IL-4, soluble IL-7, soluble IL-9, soluble IL-15, and soluble IL-21.

In some embodiments of any of the multi-chain chimeric polypeptides described herein, one or more of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is an agonistic antigen-binding domain that binds specifically to a common gamma-chain family cytokine receptor. Non-limiting examples of common gamma-chain family cytokine receptors include a receptor for one or more of IL-2, IL-4, IL-7, IL-9, IL-15, and IL-21.

In some embodiments of any of the multi-chain chimeric polypeptides described herein, one or more (e.g., two, three, four, five, six, seven, eight, nine, or ten) of the first target-binding domain (e.g., any of the exemplary target-binding domains described herein or known in the art), the second target-binding domain (e.g., any of the exemplary target-binding domains described herein or known in the art), and the one or more additional target-binding domains (e.g., any of the exemplary target-binding domains described herein or known in the art) is a soluble common gamma-chain family cytokine receptor.

In some embodiments of the multi-chain chimeric polypeptides described herein, the first domain or the second domain of a pair of affinity domains is a soluble common gamma-chain family cytokine or an antigen-binding domain that binds specifically to a common gamma-chain family cytokine receptor.

Soluble Common Gamma-Chain Family Cytokines

In some embodiments of any of the single-chain or multi-chain chimeric polypeptides described herein, one or both of the first target-binding domain and the second target-binding domain can be a soluble common gamma-chain family cytokine. In some embodiments, a common gamma-chain family cytokine receptor activating agent can be a soluble common gamma-chain family cytokine. Non-limiting examples of soluble common gamma-chain family cytokines include soluble IL-2, soluble IL-4, soluble IL-7, soluble IL-9, soluble IL-15, and soluble IL-21. Non-limiting examples of sequences for soluble IL-2, soluble IL-7, soluble IL-15, and soluble IL-21 are described herein. Non-limiting examples of soluble IL-4 and IL-9 sequences are shown below.

```
Human soluble IL-4
                                (SEQ ID NO: 335)
HKCDITLQEIIKTLNS LTEQKTLCTE LTVTDIFAAS KNTTEKETFC

RAATVLRQFY SHHEKDTRCL GATAQQFHRH KQLIRFLKRL

DRNLWGLAGL NSCPVKEANQ STLENFLERL KTIMREKYSK CSS

Human soluble IL-9
                                (SEQ ID NO: 336)
QGCPTLAGILDI NFLINKMQED PASKCHCSAN VTSCLCLGIP

SDNCTRPCFS ERLSQMTNTT MQTRYPLIFS RVKKSVEVLK

NNKCPYFSCE QPCNQTTAGN ALTFLKSLLE IFQKEKMRGM

RGKI
```

Antigen-Binding Domains

In some embodiments of any of the single-chain or multi-chain chimeric polypeptides described herein, one or both of the first target-binding domain and the second target-binding domain is an antigen-binding domain. In some embodiments of any of the single-chain or multi-chain chimeric polypeptides described herein, the first target-binding domain and the second target-binding domain are each antigen-binding domains. In some embodiments of any of the single-chain or multi-chain chimeric polypeptides described herein, the antigen-binding domain includes or is a scFv or a single domain antibody (e.g., a $V_{aH}H$ or a $V_{NAR}$ domain).

In some embodiments of any of the single-chain or multi-chain chimeric polypeptides described herein, one or both of the first target-binding domain and the second target-binding domain is an agonistic antigen-binding domain that binds specifically to a common gamma-chain family cytokine receptor. In some examples, an agonistic antigen-binding domain (e.g., any of the antigen-binding domains described herein) can bind specifically to a receptor for IL-2, IL-4, IL-7, IL-9, IL-15, or IL-21.

The antigen-binding domains present in any of the single-chain or multi-chain chimeric polypeptides described herein are each independently selected from the group consisting of: a VHH domain, a VNAR domain, and a scFv. In some embodiments, any of the antigen-binding domains described herein is a BiTe, a (scFv)$_2$, a nanobody, a nanobody-HSA, a DART, a TandAb, a scDiabody, a scDiabody-CH3, scFv-CH-CL-scFv, a HSAbody, scDiabody-HAS, or a tandem-scFv. Additional examples of antigen-binding domains that can be used in any of the single-chain or multi-chain chimeric polypeptide are known in the art.

In some embodiments, each of the antigen-binding domains in the single-chain or multi-chain chimeric polypeptides described herein are both VHH domains, or at least one antigen-binding domain is a VHH domain. In some embodiments, each of the antigen-binding domains in the single-chain or multi-chain chimeric polypeptides described herein are both VNAR domains, or at least one antigen-binding domain is a VNAR domain. In some embodiments, each of the antigen-binding domains in the single-chain or multi-chain chimeric polypeptides described herein are both scFv domains, or at least one antigen-binding domain is a scFv domain.

In some embodiments, two or more of polypeptides present in the single-chain or multi-chain chimeric polypeptide can assemble (e.g., non-covalently assemble) to form any of the antigen-binding domains described herein, e.g., an antigen-binding fragment of an antibody (e.g., any of the antigen-binding fragments of an antibody described herein), a VHH-scAb, a VHH-Fab, a Dual scFab, a F(ab')$_2$, a diabody, a crossMab, a DAF (two-in-one), a DAF (four-in-one), a DutaMab, a DT-IgG, a knobs-in-holes common light chain, a knobs-in-holes assembly, a charge pair, a Fab-arm exchange, a SEEDbody, a LUZ-Y, a Fcab, a κλ-body, an orthogonal Fab, a DVD-IgG, a IgG(H)-scFv, a scFv-(H)IgG, IgG(L)-scFv, scFv-(L)IgG, IgG(L,H)-Fv, IgG(H)-V, V(H)—IgG, IgG(L)-V, V(L)-IgG, KIH IgG-scFab, 2scFv-IgG, IgG-2scFv, scFv4-Ig, Zybody, DVI-IgG, Diabody-CH3, a triple body, a miniantibody, a minibody, a TriBi minibody, scFv-CH3 KIH, Fab-scFv, a F(ab')$_2$-scFv$_2$, a scFv-KIH, a Fab-scFv-Fc, a tetravalent HCAb, a scDiabody-Fc, a Diabody-Fc, a tandem scFv-Fc, an Intrabody, a dock and lock, a lmmTAC, an IgG-IgG conjugate, a Cov-X-Body, and a scFv1-PEG-scFv2. See, e.g., Spiess et al., *Mol. Immunol.* 67:95-106, 2015, incorporated in its entirety herewith, for a description of these elements. Non-limiting examples of an antigen-binding fragment of an antibody include an Fv fragment, a Fab fragment, a F(ab')$_2$ fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

Soluble IL-15 and IL-15 Agonists

Non-limiting examples of common gamma-chain family cytokine receptor activating agents are soluble IL-15 or IL-15 agonists. IL-15 functions through the trimeric IL-15 receptor complex, which consists of a high affinity unique binding IL-15Rα chain that confers receptor specificity for IL-15 and the common IL-15Rβ and γ-chains (also known as IL-2Rβ/γ) shared with IL-2.

In some embodiments, the soluble IL-15 is at least 90% (e.g., at least 91%, 92%, 93%, 94%, 95%, 96%, 97%, 98%, or 99%) identical to SEQ ID NO: 82. In some embodiments, the soluble IL-15 is a recombinant soluble human IL-15. In some embodiments, the soluble IL-15 is a mutant IL-15 having one or more amino acid substitutions as compared to a wild type IL-15 (e.g., SEQ ID NO: 82). The mutant IL-15 can, for example, include a D8N or a D8A amino acid substitution as compared to a wild type IL-15. In some embodiments, soluble IL-15 can be conjugated to a polymer (See, e.g. Miyazaki et al., *Proceed. Annual Meeting AACR*, 2019, Abstract 3265).

Some examples of the IL-15 agonists described herein can include a complex of IL-15 and all or a portion of a soluble IL-15 receptor (IL-15R). The complex of IL-15 and all or a portion of a soluble IL-15R may have prolonged half-life and/or higher potency as compared to free IL-15. In some embodiments, the IL-15 agonists described herein further include an Fc domain (e.g., any of the exemplary Fc domains described herein).

In some embodiments, the portion of a soluble IL-15R is IL-15Rα. For example, IL-15 can be associated with an IL-15Rα-Fc fusion to form an IL-15:IL-15Rα-Fc complex (See, e.g., those described in Stoklasek et al., *J. Immunology* 177:6072-80, 2006; Dubios et al., *J. Immunol.* 180:2099-106, 2008; Epardaud et al., *Cancer Res.* 68:2972-83, 2008; Rubinstein et al., *Proc. Natl. Acad. Sci. U.S.A.* 103:9166-71, 2006). In some embodiments, the soluble IL-15 and IL-15Rα forms a heterodimer (see, e.g. Colon et al., *Cancer Res.* 79(13 Supplement):CT082, Jul. 1, 2019).

In some embodiments, the portion of a soluble IL-15R is a portion of IL-15Rα (e.g., a sushi domain of IL-15Rα).

The IL-15 in the complex can be a wild type IL-15 or a mutant IL-15. For example, mutant IL-15 containing the N72D mutation can be used to complex with all or a portion of a soluble IL-15R (e.g., a sushi domain of IL-15Rα). In some embodiments, the complex is ALT-803, which includes a human IL-15 mutant IL-15N72D complexed with IL-15Rα sushi-Fc fusion (see, e.g. Zhu et al., *J. Immunol.* 183(6):3598-607, 2009).

Non-limiting examples of IL-15 agonists include ALT-803/N-803 (Altor Bioscience/ImmunityBio), BNZ-1 (Bioniz Therapeutics), NIZ985 (Novartis), RTX-212 (Rubius Therapeutics), AM0015 (rhIL-15) (Lilly), IGM-7354 (IGM), XmAb24306 (Roche/Xencor), KD033 (srKD033) (Kadmon), OXS-C3550 (GT Biopharma), and NKTR-255 (Nektar Therapeutics).

Soluble IL-2 and IL-2 Agonists

Non-limiting examples of common gamma-chain family cytokine receptor activating agents are soluble IL-2 or IL-2 agonists. IL-2 is a cytokine centrally involved in immune tolerance and immune activation by its effects on CD4$^+$ T regulatory cells and cytotoxic effector lymphocytes such as CD8$^+$ T cells and NK cells. IL-2 acts on cells expressing either dimeric IL-2 receptors (IL-2R) consisting of IL-2Rβ and γ chains, or trimeric αβγ receptor (IL-2Rαβγ), with the trimeric receptor displaying 10-100 fold higher affinity for IL-2 compared to dimeric IL-2Rs. $CD4^+$ T regulatory cells are characterized by strong constitutive expression of IL-2Rα, which enables the cells to express IL-2Rαβγ and thereby use low levels of IL-2. Dimeric IL-2Rs are most prominent on antigen-experienced (memory) $CD8^+$ T cells and NK cells. High levels of IL-2 therefore strongly stimulate $CD8^+$ T cells and NK cells, in addition to activating Treg cells.

In some embodiments, the soluble IL-2 is at least 90% (e.g., at least 95% identical, at least 96%, at least 97%, at least 98%, at least 99%, or 100%) identical to SEQ ID NO: 78. In some embodiments, the soluble IL-2 is a recombinant human IL-2. The soluble IL-2 can be an IL-2 variant. For example, an IL-2 variant can bind more effectively (e.g., at least 50, 100, 150 or 200 times more effectively) to IL-2Rβ than to IL-2Rα. An exemplary IL-2 variant is MDNA109 (see, e.g., Rafei et al., *J. Clin. Oncol.* 37(15 Suppl.), 2019). In some embodiments, the IL-2 variant has abolished CD25 binding. For example, residues F42, Y45, and L72 which are involved in CD25 binding can be mutated (see, e.g., Klein et al., *Oncoimmunology* 6(3):e1277306, 2017).

In some embodiments, the IL-2 agonist is a PEGylated IL-2 that has limited binding to the IL2Rα subunit and preferentially binds the dimeric IL2Rβγ (see, e.g., Bentebibel et al., *Cancer Discov.* 9(6):711-721, 2019).

Some examples of IL-2 agonists described herein are fusion proteins that include an IL-2. In some embodiments, the fusion proteins include IL-2 or a variant thereof linked to all or a portion of a soluble IL-2R. In some embodiments, the portion of a soluble IL-2R is IL-2Rα (See, e.g., Vaishampayan et al., *J. Clin. Oncol.* 35 (15 Suppl.), 2017). The fusion proteins can, for example, selectively activate the dimeric IL-2Rβγ. Further examples of IL-2 fusion proteins include those fused to a toxin (e.g., a diphtheria toxin).

In some embodiments, the fusion proteins include an IL-2 or a variant thereof (e.g., any of the IL-2 variant described herein) linked to an antibody (e.g., a monoclonal antibody or an scFv). Non-limiting examples of antibodies that can be linked to an IL-2 or a variant thereof include a human monoclonal antibody against fibroblast activation protein-alpha (FAP) (see, e.g., Soerensen et al., *J. Clin. Oncol.* 36, No. 15 Suppl.), an anti-CD20 monoclonal antibody (see, e.g., Lansigan et al., *Blood* 128(22):620, 2016), an scFv against the A1 domain of tenascin-C (see, e.g. Catania et al., *Cell Adh. Migr.* 9(1-2):14-21, 2015); and an anti-CEA antibody (See, e.g., Klein et al., *Oncoimmunol.* 6(3): e1277306, 2017).

Additional examples of IL-2 agonists include Proleukin (Clinigen), pulmoleukin (Immunservice), NKTR-214 (Nektar Therapeutics), DI-Leu16-IL2 (Alopexx/Provenance Biopharmaceuticals), RG7461 (Roche), Teleukin (Philogen), ALT-801803 (Altor Bioscience), ALT-801 (Altor Bioscience), ALKS 4230 (Alkermes), cergutuzumab amunaleukin (RG7813) (Roche), Camidanlumab tesirine (ADC Therapeutics/Genbmab), NHS-IL2-LT/EMD 521873 (Merck KGaA), NIZ985 (Novartis), MDNA109 (Medicenna Therapeutics), Angeloxin (Angelica Therapeutics), PB101 (Pivotal Biosciences), Anti-IL-2 Program (Xoma), NKTR-255 (Nektar Therapeutics), NKTR-358/LY3471851 (Nektar Therapeutics/Lilly), CYP 0150 (Cytunepharma), NL-201 (Neoleukin), THOR-809 (Sanofi/Synthorx), BNT151/153 (BioNTech), TransCon IL-2 β/γ (Ascendis Pharma), ILT-101 (Servier/ILT-101) and AM0015 (Lilly). Additional examples of IL-2 agonists are known in the art.

Complexes of Common Gamma-Chain Family Cytokine and an Antibody or Antibody Fragment Non-limiting examples of common gamma-chain family cytokine receptor activating agents are complexes including a common gamma-chain family cytokine (e.g., any of the common gamma-chain family cytokines described herein) and an antibody or antigen-binding antibody fragment that binds specifically to the common gamma-chain family cytokine.

In some embodiments, the complex of a common gamma-chain family cytokine and antibody or antigen-binding antibody fragment binding specifically to the common gamma-chain family cytokine can enhance the activity of the common gamma-chain family cytokines, and lead to expansion of $CD8^+$ T cells and/or NK cells. In some embodiments, the complex has longer half-life in circulation than the free common gamma-chain family cytokine.

In some embodiments, the complex can comprise soluble IL-2 (e.g., recombinant soluble human IL-2) or a functional fragment thereof, and an anti-IL-2 antibody or an antigen-binding antibody fragment thereof. Non-limiting examples of complexes of soluble IL-2 and anti-IL-2 antibodies include soluble IL-2 complexed with anti-IL-2 antibodies S4B6, JES6-5, or MAB602, respectively (see, e.g., Tomala et al., *J. Immunol.* 183:4904-4912, 2009; and Boyman et al., *Science* 311, 2006).

In some embodiments, the complex can comprise soluble IL-4 (e.g., recombinant soluble human IL-4) and an anti-IL-4 antibody or an antigen-binding antibody fragment thereof. Non-limiting examples of anti-IL-4 antibodies include those described in e.g., Sato et al., *J. Immunol.* 150:2717-2723, 1993, and Finkelman et al., *J. Immunol.* 151:1235-1244, 1993.

In some embodiments, the complex can comprise soluble IL-7 (e.g., recombinant soluble human IL-7) and an anti-IL-7 antibody or an antigen-binding antibody fragment thereof. Non-limiting examples of anti-IL-7 antibodies include those described in e.g., Finkelman et al., *J. Immunol.* 151:1235-1244, 1993, and Boyman et al., *J. Immunol.* 180:7265-75, 2008.

In some examples of the complexes, the common gamma-chain family cytokine (or a functional fragment thereof) and the antibody (or an antigen-binding antibody fragment thereof) can be administered separately, and the complex between the common gamma-chain family cytokine and the antibody or the antigen-binding antibody fragment can be formed in vivo.

Additional example of common gamma-chain family cytokines and corresponding antibodies or antigen-binding antibody fragments that binds to the same are known in the art.

Exemplary Methods that Include Administration of One or More Agent(s) that Result in a Decrease in the Activation of a TGF-β Receptor Provided herein are methods of killing or reducing the number of naturally-occurring and/or treatment-induced senescent cells in a subject that include administering to the subject a therapeutically effective amount of one or more agent(s) that result(s) in a decrease in the activation of a TGF-β receptor.

Also provided herein are methods of decreasing the accumulation of naturally-occurring and/or treatment-induced senescent cells in a subject that include administering to the subject a therapeutically effective amount of one or more agent(s) that result(s) in a decrease in the activation of a TGF-β receptor.

Also provided herein are methods of decreasing a level of a marker of naturally-occurring and/or treatment-induced senescent cells in a subject that include administering to the subject a therapeutically effective amount of one or more agent(s) that result(s) in a decrease in the activation of a TGF-β receptor. In some embodiments, a marker of naturally-occurring and/or treatment-induced senescent cells is p21$^{CIP1}$p21 and CD26. Additional markers of naturally-occurring and/or treatment-induced senescent cells are described herein. Additional markers of naturally-occurring and/or treatment-induced senescent cells are known in the art.

Also provided herein are methods of reducing the activity of naturally-occurring and/or treatment-induced senescent cells in a subject that include administering to the subject a therapeutically effective amount of one or more agent(s) that result(s) in a decrease in the activation of a TGF-β receptor.

Also provided herein are methods of decreasing levels and/or activity of one or more SASP factor(s) derived from naturally-occurring and/or treatment-induced senescent cells in a subject that include administering to the subject a therapeutically effective amount of one or more agent(s) that result(s) in a decrease in the activation of a TGF-β receptor. In some embodiments, senescent cells express an inflammatory signature, where the inflammatory signature is a SASP factor. In some embodiments, the SASP factor includes, but is not limited to, inflammatory cytokines (e.g., IL-1α, IL-1β, IL-6, IL-8, and TNF-α), growth factors (e.g., TGF-β, PDGF-AA, and insulin-like growth factor-binding proteins (IGFBPs)), chemokines (e.g., CCL-2, CCL-20, CCL-7, CXCL-4, CXCL1, and CXCL-12), and matrix metalloproteinases (e.g., MMP-3 and MMP-9) that operate in a cell-autonomous manner to reinforce senescence (autocrine effects) and communicate with and modify the microenvironment (paracrine effects). In some embodiments, the method decreases expression levels or activity of one or more of the SASP factor(s). In some embodiments, the expression level or activity of a SASP factor is determined using enzyme-linked immunosorbent assay (ELISA). In some embodiments, the expression level or activity of a SASP factor is determined using immunoblotting.

In some embodiments of any of the methods described herein, the subject has been previously diagnosed or identified as having an aging-related disease (e.g. any of the exemplary types of aging-related disease or condition described herein or known in the art) or an inflammatory disease (e.g. any of the exemplary types of aging-related disease or condition described herein or known in the art).

In some embodiments, the aging-related disease is inflamm-aging related.

In some embodiments, the aging-related disease is a cancer (e.g. any of the exemplary types of cancer described herein or known in the art).

In some embodiments of any of the methods described herein, the inflammatory disease is selected from the group consisting of: rheumatoid arthritis, inflammatory bowel disease, lupus erythematosus, lupus nephritis, diabetic nephropathy, CNS injury, Alzheimer's disease, Parkinson's disease, amyotrophic lateral sclerosis, Crohn's disease, multiple sclerosis, Guillain-Barre syndrome, psoriasis, Grave's disease, ulcerative colitis, nonalcoholic steatohepatitis, mood disorders and cancer treatment-related cognitive impairment.

In some examples of these methods, the treatment-induced senescent cells are chemotherapy-induced senescent cells.

In some embodiments of these methods, the administering results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the number of naturally-occurring and/or treatment-induced senescent cells in a target tissue (e.g., any of the exemplary types of target tissues described herein or known in the art) in the subject, e.g., as compared to the number of naturally-occurring and/or treatment-induced senescent cells in the target tissue in the subject prior to treatment.

In some embodiments of these methods, the administering results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in the accumulation of naturally-occurring and/or treatment-induced senescent cells in the subject (e.g., any of the periods of time described herein), e.g., as compared to the accumulation of naturally-occurring and/or treatment-induced senescent cells in the subject prior to treatment or the accumulation of naturally-occurring and/or treatment-induced senescent cells in a similar subject not receiving a treatment.

In some embodiments of these methods, the administering results in a decrease (e.g., at least a 5% decrease, at least a 10% decrease, at least a 15% decrease, at least a 20% decrease, at least a 25% decrease, at least a 30% decrease, at least a 35% decrease, at least a 40% decrease, at least a 45% decrease, at least a 50% decrease, at least a 55% decrease, at least a 60% decrease, at least a 65% decrease, at least a 70% decrease, at least a 75% decrease, at least a 80% decrease, at least a 85% decrease, at least a 90% decrease, or at least a 95% decrease, or about a 5% decrease to about a 99% decrease (or any of the subranges of this range described herein)) in a level of one or more (e.g., two, three, or four) marker(s) of naturally-occurring and/or treatment-induced senescent cells in the subject, e.g., as compared to the level of the one or more marker(s) of naturally-occurring and/or treatment-induced senescent cells in the subject prior to treatment.

In some embodiments, the TGF-β receptor is a TGF-β receptor II (TGF-βRII).

In some embodiments, the TGF-β receptor is a TGF-βRIII.

In some embodiments, at least one of the one or more agent(s) that result(s) in a decrease in the activation of a TGF-β receptor is a soluble TGF-β receptor, an extracellular domain of TGF-β receptor, an antibody that binds specifically to TGF-β, an antagonistic antibody that binds to a TGF-β receptor, an agent that binds to a LAP, or an agent that binds to a TGF-β/LAP complex. In some embodiments, the one or more agent(s) that result(s) in a decrease in the activation of a TGF-β receptor decrease(s) the activation of a TGF-β receptor through binding to a LAP, or to a TGF-β/LAP complex. Non-limiting examples of agents that result in a decrease in the activation of a TGF-β receptor are described below.

Agent(s) that Result in a Decrease in the Activation of a TGF-β Receptor

Provided herein are methods that include the use or administration of one or more agent(s) that result(s) in a decrease in the activation of a TGF-β receptor. In some embodiments, the agent that results in a decrease in the activation of a TGF-β receptor is a single-chain chimeric polypeptide (e.g. any of the exemplary single-chain chimeric polypeptides described herein), a multi-chain chimeric polypeptide (e.g. any of the exemplary multi-chain chimeric polypeptides described herein), a soluble TGF-β receptor, an extracellular domain of TGF-β receptor, an antibody (or antibody fragment) that binds specifically to TGF-β, an antagonistic antibody that binds to a TGF-β receptor, an agent that binds to a LAP, or an agent that binds to a TGF-β/LAP complex.

Exemplary Single-Chain Chimeric Polypeptide

Non-limiting examples of agents that result in a decrease in the activation of a TGF-β receptor are single-chain chimeric polypeptides that include: (i) a first target-binding domain, (ii) a soluble tissue factor domain (e.g., any of the exemplary soluble tissue factor domains described herein or known in the art), and (iii) a second target-binding domain, where one or both of the first target-binding domain and the second target-binding domain binds specifically to a ligand of a TGF-β receptor; or one or both of the first target-binding domain and the second target-binding domain is an antagonistic antigen-binding domain that binds specifically to a TGF-β receptor. In some embodiments, the TGF-β receptor is TGF-βRII. In some embodiments, the TGF-β receptor is TGF-βRIII.

Some embodiments of any of the single-chain chimeric polypeptides described herein can further include one or more (e.g., two, three, four, five, six, seven, eight, nine, or ten) additional target-binding domains (e.g., any of the exemplary target-binding domains described herein or known in the art) at its N- and/or C-terminus.

In some embodiments of any of the single-chain chimeric polypeptide described herein, the first target-binding domain (e.g., any of the exemplary target-binding domains described herein or known in the art) and/or the second target-binding domain (e.g., any of the exemplary target-binding domains described herein or known in the art) is a soluble TGF-β receptor. Non-limiting examples of soluble TGF-β receptors include soluble TGFβRI, soluble TGFβRII, soluble TGFβRIII, and soluble endoglin. Non-limiting sequences for an exemplary soluble TGFβRII are described herein.

Exemplary Multi-Chain Chimeric Polypeptide

Non-limiting examples of agents that result in a decrease in the activation of a TGF-β receptor are multi-chain chimeric polypeptides that include: (a) a first chimeric polypeptide including: (i) a first target-binding domain; (ii) a soluble tissue factor domain; and (iii) a first domain of a pair of affinity domains; and (b) a second chimeric polypeptide including: (i) a second domain of a pair of affinity domains; and (ii) a second target-binding domain, where one or both of the first target-binding domain and the second target-binding domain binds specifically to a ligand of a TGF-β receptor; or one or both of the first target-binding domain and the second target-binding domain is an antagonistic antigen-binding domain that binds specifically to a TGF-β receptor.

In some embodiments of any of the multi-chain chimeric polypeptides, the first chimeric polypeptide further includes one or more (e.g., two, three, four, five, six, seven, eight, nine, or ten) additional target-binding domain(s) (e.g., any of the exemplary target-binding domains described herein or known in the art).

In some embodiments of any of the multi-chain chimeric polypeptides, the second chimeric polypeptide further includes one or more (e.g., two, three, four, five, six, seven, eight, nine, or ten) additional target-binding domain(s) (e.g., any of the exemplary target-binding domains described herein or known in the art).

In some embodiments of any of the multi-chain chimeric polypeptide described herein, the first target-binding domain (e.g., any of the exemplary target-binding domains described herein or known in the art) and/or the second target-binding domain (e.g., any of the exemplary target-binding domains described herein or known in the art) is a soluble TGF-β receptor. Non-limiting examples of soluble TGF-β receptors include soluble TGFβRI, soluble TGFβRII, soluble TGFβRIII, and soluble endoglin.

In some embodiments of any of the multi-chain chimeric polypeptide described herein, the pair of affinity domains is a sushi domain from an alpha chain of human IL-15 receptor (IL15Rα) and a soluble IL-15. In some embodiments of any of the multi-chain chimeric polypeptide described herein, the soluble IL-15 has a D8N or D8A amino acid substitution. In some embodiments, the soluble IL-15 comprises a mutation to reduce or eliminate IL-15 activity.

In some embodiments of any of the multi-chain chimeric polypeptide described herein, the pair of affinity domains is selected from the group consisting of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25. In some embodiments of any of the multi-chain chimeric polypeptide described herein, the first domain or the second domain of a pair of affinity domains is a soluble common gamma-chain family cytokine or an antigen-binding domain that binds specifically to a common gamma-chain family cytokine receptor.

Non-limiting examples of multi-chain chimeric polypeptides that are agents that result in a decrease in the activation of a TGF-β receptor are those described in subsections herein titled "Exemplary Multi-Chain Chimeric Polypeptides-Type B, G, I, K, L, M, N, O, and P."

Soluble TGFβ Receptors

In some embodiments, one or more agent(s) that result(s) in a decrease in the activation of a TGF-β receptor is a soluble TGF-β receptor. In some embodiments, one or more agent(s) that result(s) in a decrease in the activation of a TGF-β receptor is a soluble TGF-β receptor. Non-limiting examples of soluble TGF-β receptors include soluble TGFβRI, soluble TGFβRII, soluble TGFβRIII, and soluble endoglin.

In some embodiments, the TGF-β receptor is a TGF-β receptor II (TGFβRII). In some embodiments, the TGFβ receptor is a TGFβRIII.

TGFβRI, the type I receptor is a membrane-bound serine/threonine kinase that requires the presence of TGFβRII to bind TGF-β. TGFβRII, the type II receptor is a membrane-bound serine/threonine kinase that binds TGF-β 1 and TGF-β 3 with high affinity and TGF-β2 with a much lower affinity. In some embodiments, signal transduction requires the cytoplasmic domains of both TGFβRI and TGFβRII. TGF-βRIII, the type III receptor is a proteoglycan that exists in membrane-bound and soluble forms, and binds TGF-β1, TGF-β2, and TGF-β3, but does not appear to be involved in signal transduction. Non-limiting examples of sequences for soluble TGFβRII are described herein.

Antigen-Binding Domains

In some embodiments of any of the single-chain or multi-chain chimeric polypeptides described herein, one or both of the first target-binding domain and the second target-binding domain is an antigen-binding domain. In some embodiments of any of the single-chain or multi-chain chimeric polypeptides described herein, the first target-binding domain and the second target-binding domain are each antigen-binding domains. In some embodiments of any of the single-chain or multi-chain chimeric polypeptides described herein, the antigen-binding domain includes or is a scFv or a single domain antibody (e.g., a VHH or a VNAR domain).

In some embodiments of any of the single-chain or multi-chain chimeric polypeptides described herein, one or both of the first target-binding domain and the second target-binding domain is an antagonistic antigen-binding domain that binds specifically to a TGF-β receptor. In some examples, an antagonistic antigen-binding domain (e.g., any of the antigen-binding domains described herein) can bind specifically to a soluble TGFβRI, soluble TGFβRII, soluble TGFβRIII, or soluble endoglin.

In some embodiments, any of the antigen-binding domains described herein is a BiTe, a (scFv)$_2$, a nanobody, a nanobody-HSA, a DART, a TandAb, a scDiabody, a scDiabody-CH3, scFv-CH-CL-scFv, a HSAbody, scDiabody-HSA, or a tandem-scFv. Additional examples of antigen-binding domains that can be used in any of the single-chain or multi-chain chimeric polypeptide are known in the art.

In some embodiments, two or more of polypeptides present in the single-chain or multi-chain chimeric polypeptide can assemble (e.g., non-covalently assemble) to form any of the antigen-binding domains described herein, e.g., an antigen-binding fragment of an antibody (e.g., any of the antigen-binding fragments of an antibody described herein), a VHH-scAb, a VHH-Fab, a Dual scFab, a F(ab')$_2$, a diabody, a crossMab, a DAF (two-in-one), a DAF (four-in-one), a DutaMab, a DT-IgG, a knobs-in-holes common light chain, a knobs-in-holes assembly, a charge pair, a Fab-arm exchange, a SEEDbody, a LUZ-Y, a Fcab, a κλ-body, an orthogonal Fab, a DVD-IgG, a IgG(H)-scFv, a scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv, scFv4-Ig, Zybody, DVI-IgG, Diabody-CH3, a triple body, a miniantibody, a minibody, a TriBi minibody, scFv-CH3 Kill, Fab-scFv, a F(ab')$_2$-scFv$_2$, a scFv-KIH, a Fab-scFv-Fc, a tetravalent HCAb, a scDiabody-Fc, a Diabody-Fc, a tandem scFv-Fc, an Intrabody, a dock and lock, a lmmTAC, an IgG-IgG conjugate, a Cov-X-Body, and a scFv1-PEG-scFv2. See, e.g., Spiess et al., *Mol. Immunol.* 67:95-106, 2015, incorporated in its entirety herewith, for a description of these elements.

Non-limiting examples of an antigen-binding fragment of an antibody include an Fv fragment, a Fab fragment, a F(ab')$_2$ fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

Agents that Bind to a Latency-Associated Peptide (LAP)

Non-limiting examples of agents that bind to a latency-associated peptide (LAP) are TGF-β1, thrombospondin-1 (TSP-1), integrin αvβ6, or KRFK peptide. In some embodiments, LAP binds TGF-β1, forming a latent complex, wherein LAP is presumed to function as a sequestering agent for active TGF-β1. In some embodiments, LAP of the latent TGF-β complex also interacts with thrombospondin-1 (TSP-1) as part of a biologically active complex. TSP-1/LAP complex formation involves the activation sequence of TPS-1 (KRFK) and a sequence (LSKL) near the amino terminus of LAP that is conserved in TGF-β1-5. The interactions of LAP with TSP-1 through the LSKL and KRFK sequences are important for thrombospondin-mediated activation of latent TGF-β since LSKL peptides can competitively inhibit latent TGF-β activation by TSP-1 or KRFK-containing peptides. In some embodiments, integrin αvβ6 has been shown to have high affinity for the TGF-β1 LAP and to participate in the activation of the TGF-β1 latent complex.

Agents that Bind to a TGF-β/LAP Complex

Non-limiting examples of agents that bind to a TFG-β/LAP complex are latent TGF-β binding proteins (LTBP). In some embodiments, the latent TGF-β binding protein (LTBP) binds a TFG-β/LAP complex, forming a larger complex called large latent complex (LLC). In some embodiments, LTBPs include LTBP-1, LTBP-2, LTBP-3 and LTBP-4. In some embodiments, LTBP-1 forms a disulfide linked complex with the TGFβ propeptide (e.g., LAP) in the endoplasmic reticulum. In some embodiments, LTBP-4 binds only to TGF-β1, thus, mutation in LTBP-4 can lead to TGF-β associated complications which are specific to tissues that predominantly involve TGF-β1.

Methods of Administration

Some embodiments of the methods described herein include administering one or two or more (e.g., three or more, four or more, five or more, six or more, seven or more, eight or more, nine or more, or ten or more) doses of the one or more agent(s) that result(s) in a decrease in the activation of a TGF-β receptor to the subject. In some embodiments of these methods, any two consecutive doses of the two or more doses are administered about 1 week to about one year apart (e.g., about 1 week to about 11 months, about 1 week to about 10 months, about 1 week to about 9 months, about 1 week to about 8 months, about 1 week to about 7 months, about 1 week to about 6 months, about 1 week to about 5 months, about 1 week to about 4 months, about 1 week to about 3 months, about 1 week to about 2 months, about 1 week to about 1 months, about 1 week to about 3 weeks, about 1 week to about 2 weeks, about 2 weeks to about 12 months, about 2 weeks to about 11 months, about 2 weeks to about 10 months, about 2 weeks to about 9 months, about 2 weeks to about 8 months, about 2 weeks to about 7 months, about 2 weeks to about 6 months, about 2 weeks to about 5 months, about 2 weeks to about 4 months, about 2 weeks to about 3 months, about 2 weeks to about 2 months, about 2 weeks to about 1 months, about 2 weeks to about 3 weeks, about 3 weeks to about 12 months, about 3 weeks to about 11 months, about 3 weeks to about 10 months, about 3 weeks to about 9 months, about 3 weeks to about 8 months, about 3 weeks to about 7 months, about 3 weeks to about 6 months, about 3 weeks to about 5 months, about 3 weeks to about 4 months, about 3 weeks to about 3 months, about 3 weeks to about 2 months, about 3 weeks to about 1 month, about 1 month to about 12 months, about 1 month to about 11 months, about 1 month to about 10 months, about 1 month to about 9 months, about 1 month to about 8 months, about 1 month to about 7 months, about 1 month to about 6 months, about 1 month to about 5 months, about 1 month to about 4 months, about 1 month to about 3 months, about 1 month to about 2 months, about 2 months to about 12 months, about 2 months to about 11 months, about 2 months to about 10 months, about 2 months to about 9 months, about 2 months to about 8 months, about 2 months to about 7 months, about 2 months to about 6 months, about 2 months to about 5 months, about 2 months to about 4 months, about 2 month to about 3 months, about 3 months to about 12 months, about 3 months to about 11 months, about 3 months to about 10 months, about 3 months to about 9 months, about 3 months to about 8 months, about 3 months to about 7 months, about 3 months to about 6 months, about 3 months to about 5 months, about 3 months to about 4 months, about 4 months to about 12 months, about 4 months to about 11 months, about 4 months to about 10 months, about 4 months to about 9 months, about 4 months to about 8 months, about 4 months to about 7 months, about 4 months to about 6 months, about 4 months to about 5 months, about 4 months to about 4 months, about 5 months to about 12 months, about 5 months to about 11 months, about 5 months to about 10 months, about 5 months to about 9 months, about 5 months to about 8 months, about 5 months to about 7 months, about 5 months to about 6 months, about 6 months to about 12 months, about 6 months to about 11 months, about 6 months to about 10 months, about 6 months to about 9 months, about 6 months to about 8 months, about 6 months to about 7 months, about 7 months to about 12 months, about 7 months to about 11 months, about 7 months to about 10 months, about 7 months to about 9 months, about 7 months to about 8 months, about 8 months to about 12 months, about 8 months to about 11 months, about 8 months to about 10 months, about 8 months to about 9 months, about 9 months to about 12 months, about 9 months to about 11 months, about 9 months to about 10 months, about 10 months to about 12 months, about 10 months to about 11 months, or about 11 months to about 12 months apart).

In some embodiments of any of the methods described herein, the one or two or more doses are administered by subcutaneous administration. In some embodiments of any of the methods described herein, the one or two or more doses are administered by intramuscular administration.

In some embodiments of any of the methods described herein, the two or more doses are administered over a period of time of about 1 year to about 60 years (e.g., about 1 year to about 55 years, about 1 year to about 50 years, about 1 year to about 45 years, about 1 year to about 40 years, about 1 year to about 35 years, about 1 year to about 30 years, about 1 year to about 25 years, about 1 year to about 20 years, about 1 year to about 15 years, about 1 year to about 10 years, about 1 year to about 5 years, about 5 years to about 60 years, about 5 years to about 55 years, about 5 years to about 50 years, about 5 years to about 45 years, about 5 years to about 40 years, about 5 years to about 35 years, about 5 years to about 30 years, about 5 years to about 25 years, about 5 years to about 20 years, about 5 years to about 15 years, about 5 years to about 10 years, about 10 years to about 60 years, about 10 years to about 55 years, about 10 years to about 50 years, about 10 years to about 45 years, about 10 years to about 40 years, about 10 years to about 35 years, about 10 years to about 30 years, about 10 years to about 25 years, about 10 years to about 20 years, about 10 years to about 15 years, about 15 years to about 60 years, about 15 years to about 55 years, about 15 years to about 50 years, about 15 years to about 45 years, about 15 years to about 40 years, about 15 years to about 35 years, about 15 years to about 30 years, about 15 years to about 25 years, about 15 years to about 20 years, about 20 years to about 60 years, about 20 years to about 55 years, about 20 years to about 50 years, about 20 years to about 45 years, about 20 years to about 40 years, about 20 years to about 35 years, about 20 years to about 30 years, about 20 years to about 25 years, about 25 years to about 60 years, about 25 years to about 55 years, about 25 years to about 50 years, about 25 years to about 45 years, about 25 years to about 40 years, about 25 years to about 35 years, about 25 years to about 30 years, about 30 years to about 60 years, about 30 years to about 55 years, about 30 years to about 50 years, about 30 years to about 45 years, about 30 years to about 40 years, about 30 years to about 35 years, about 35 years to about 60 years, about 35 years to about 55 years, about 35 years to about 50 years, about 35 years to about 45 years, about 35 years to about 40 years, about 40 years to about 60 years, about 40 years to about 55 years, about 40 years to about 50 years, about 40 years to about 45 years, about 45 years to about 60 years, about 45 years to about 55 years, about 45 years to about 50 years, about 50 years to about 60 years, about 50 years to about 55 years, or about 55 years to about 60 years).

In some embodiments of these methods, each of the one or two or more doses are administered at a dosage of about 0.01 mg of each agent that results in a decrease in the activation of a TGF-β receptor/kg to about 10 mg of each agent that results in a decrease in the activation of a TGF-β receptor/kg (e.g., about 0.01 mg/kg to about 9 mg/kg, about 0.01 mg/kg to about 8 mg/kg, about 0.01 mg/kg to about 7 mg/kg, about 0.01 mg/kg to about 6 mg/kg, about 0.01 mg/kg to about 5 mg/kg, about 0.01 mg/kg to about 4 mg/kg, about 0.01 mg/kg to about 3 mg/kg, about 0.01 mg/kg to about 2 mg/kg, about 0.01 mg/kg to about 1 mg/kg, about 0.01 mg/kg to about 0.5 mg/kg, about 0.01 mg/kg to about 0.1 mg/kg, about 0.01 mg/kg to about 0.05 mg/kg, about 0.05 mg/kg to about 10 mg/kg, about 0.05 mg/kg to about 9 mg/kg, about 0.05 mg/kg to about 8 mg/kg, about 0.05 mg/kg to about 7 mg/kg, about 0.05 mg/kg to about 6 mg/kg, about 0.05 mg/kg to about 5 mg/kg, about 0.05 mg/kg to about 4 mg/kg, about 0.05 mg/kg to about 3 mg/kg, about 0.05 mg/kg to about 2 mg/kg, about 0.05 mg/kg to about 1 mg/kg, about 0.05 mg/kg to about 0.5 mg/kg, about 0.05 mg/kg to about 0.1 mg/kg, about 0.1 mg/kg to about 10 mg/kg, about 0.1 mg/kg to about 9 mg/kg, about 0.1 mg/kg to about 8 mg/kg, about 0.1 mg/kg to about 7 mg/kg, about 0.1 mg/kg to about 6 mg/kg, about 0.1 mg/kg to about 5 mg/kg, about 0.1 mg/kg to about 4 mg/kg, about 0.1 mg/kg to about 3 mg/kg, about 0.1 mg/kg to about 2 mg/kg, about 0.1 mg/kg to about 1 mg/kg, about 0.1 mg/kg to about 0.5 mg/kg, about 0.5 mg/kg to about 10 mg/kg, about 0.5 mg/kg to about 9 mg/kg, about 0.5 mg/kg to about 8 mg/kg, about 0.5 mg/kg to about 7 mg/kg, about 0.5 mg/kg to about 6 mg/kg, about 0.5 mg/kg to about 5 mg/kg, about 0.5 mg/kg to about 4 mg/kg, about 0.5 mg/kg to about 3 mg/kg, about 0.5 mg/kg to about 2 mg/kg, about 0.5 mg/kg to about 1 mg/kg, about 1 mg/kg to about 10 mg/kg, about 1 mg/kg to about 9 mg/kg, about 1 mg/kg to about 8 mg/kg, about 1 mg/kg to about 7 mg/kg, about 1 mg/kg to about 6 mg/kg, about 1 mg/kg to about 5 mg/kg, about 1 mg/kg to about 4 mg/kg, about 1 mg/kg to about 3 mg/kg, about 1 mg/kg to about 2 mg/kg, about 2 mg/kg to about 10 mg/kg, about 2 mg/kg to about 9 mg/kg, about 2 mg/kg to about 8 mg/kg, about 2 mg/kg to about 7 mg/kg, about 2 mg/kg to about 6 mg/kg, about 2 mg/kg to about 5 mg/kg, about 2 mg/kg to about 4 mg/kg, about 2 mg/kg to about 3 mg/kg, about 3 mg/kg to about 10 mg/kg, about 3 mg/kg to about 9 mg/kg, about 3 mg/kg to about 8 mg/kg, about 3 mg/kg to about 7 mg/kg, about 3 mg/kg to about 6 mg/kg, about 3 mg/kg to about 5 mg/kg, about 3 mg/kg to about 4 mg/kg, about 4 mg/kg to about 10 mg/kg, about 4 mg/kg to about 9 mg/kg, about 4 mg/kg to about 8 mg/kg, about 4 mg/kg to about 7 mg/kg, about 4 mg/kg to about 6 mg/kg, about 4 mg/kg to about 5 mg/kg, about 5 mg/kg to about 10 mg/kg, about 5 mg/kg to about 9 mg/kg, about 5 mg/kg to about 8 mg/kg, about 5 mg/kg to about 7 mg/kg, about 5 mg/kg to about 6 mg/kg, about 6 mg/kg to about 10 mg/kg, about 6 mg/kg to about 9 mg/kg, about 6 mg/kg to about 8 mg/kg, about 6 mg/kg to about 7 mg/kg, about 7 mg/kg to about 10 mg/kg, about 7 mg/kg to about 9 mg/kg, about 7 mg/kg to about 8 mg/kg, about 8 mg/kg to about 10 mg/kg, about 8 mg/kg to about 9 mg/kg, or about 8 mg/kg to about 10 mg/kg of each agent that results in a decrease in the activation of a TGF-β receptor).

In some embodiments of these methods, a single or first dose of the one or more agent(s) that result(s) in a decrease in the activation of a TGF-β receptor begins when the subject reaches an age of at least 30 years (e.g., at least 32, 34, 36, 38, 40, 42, 44, 46, 48, 50, 52, 54, 56, 58, 60, 62, 65, 70, 75, or 80 years).

In some embodiments of any of the methods described herein, the subject is not diagnosed or identified as having an aging-related disease (e.g., any of the aging-related disease or condition described herein or known in the art) or an inflammatory disease (e.g., any of the inflammatory diseases described herein or known in the art). In some embodiments of any of the methods described herein, the subject has not been previously treated with a chemotherapeutic agent (e.g., any of the chemotherapeutic agents described herein or known in the art). In some embodiments of any of the methods described herein, the subject has not been previously treated with a therapeutic agent that induces cellular senescence (e.g. any of the additional therapeutic agents that induce cellular senescence described herein).

Some embodiments of the methods described herein include administering one or two or more (e.g., three or more, four or more, five or more, six or more, seven or more, eight or more, nine or more, or ten or more) doses of the one or more common gamma-chain family cytokine receptor activating agent(s) to the subject. In some embodiments of these methods, any two consecutive doses of the two or more doses are administered about 1 week to about one year apart (e.g., about 1 week to about 11 months, about 1 week to about 10 months, about 1 week to about 9 months, about 1 week to about 8 months, about 1 week to about 7 months, about 1 week to about 6 months, about 1 week to about 5 months, about 1 week to about 4 months, about 1 week to about 3 months, about 1 week to about 2 months, about 1 week to about 1 months, about 1 week to about 3 weeks, about 1 week to about 2 weeks, about 2 weeks to about 12 months, about 2 weeks to about 11 months, about 2 weeks to about 10 months, about 2 weeks to about 9 months, about 2 weeks to about 8 months, about 2 weeks to about 7 months, about 2 weeks to about 6 months, about 2 weeks to about 5 months, about 2 weeks to about 4 months, about 2 weeks to about 3 months, about 2 weeks to about 2 months, about 2 weeks to about 1 months, about 2 weeks to about 3 weeks, about 3 weeks to about 12 months, about 3 weeks to about 11 months, about 3 weeks to about 10 months, about 3 weeks to about 9 months, about 3 weeks to about 8 months, about 3 weeks to about 7 months, about 3 weeks to about 6 months, about 3 weeks to about 5 months, about 3 weeks to about 4 months, about 3 weeks to about 3 months, about 3 weeks to about 2 months, about 3 weeks to about 1 month, about 1 month to about 12 months, about 1 month to about 11 months, about 1 month to about 10 months, about 1 month to about 9 months, about 1 month to about 8 months, about 1 month to about 7 months, about 1 month to about 6 months, about 1 month to about 5 months, about 1 month to about 4 months, about 1 month to about 3 months, about 1 month to about 2 months, about 2 months to about 12 months, about 2 months to about 11 months, about 2 months to about 10 months, about 2 months to about 9 months, about 2 months to about 8 months, about 2 months to about 7 months, about 2 months to about 6 months, about 2 months to about 5 months, about 2 months to about 4 months, about 2 month to about 3 months, about 3 months to about 12 months, about 3 months to about 11 months, about 3 months to about 10 months, about 3 months to about 9 months, about 3 months to about 8 months, about 3 months to about 7 months, about 3 months to about 6 months, about 3 months to about 5 months, about 3 months to about 4 months, about 4 months to about 12 months, about 4 months to about 11 months, about 4 months to about 10 months, about 4 months to about 9 months, about 4 months to about 8 months, about 4 months to about 7 months, about 4 months to about 6 months, about 4 months to about 5 months, about 4 months to about 4 months, about 5 months to about 12 months, about 5 months to about 11 months, about 5 months to about 10 months, about 5 months to about 9 months, about 5 months to about 8 months, about 5 months to about 7 months, about 5 months to about 6 months, about 6 months to about 12 months, about 6 months to about 11 months, about 6 months to about 10 months, about 6 months to about 9 months, about 6 months to about 8 months, about 6 months to about 7 months, about 7 months to about 12 months, about 7 months to about 11 months, about 7 months to about 10 months, about 7 months to about 9 months, about 7 months to about 8 months, about 8 months to about 12 months, about 8 months to about 11 months, about 8 months to about 10 months, about 8 months to about 9 months, about 9 months to about 12 months, about 9 months to about 11 months, about 9 months to about 10 months, about 10 months to about 12 months, about 10 months to about 11 months, or about 11 months to about 12 months apart).

In some embodiments of any of the methods described herein, the one or two or more doses are administered by subcutaneous administration. In some embodiments of any of the methods described herein, the one or two or more doses are administered by intramuscular administration.

In some embodiments of any of the methods described herein, the two or more doses are administered over a period of time of about 1 year to about 60 years (e.g., about 1 year to about 55 years, about 1 year to about 50 years, about 1 year to about 45 years, about 1 year to about 40 years, about 1 year to about 35 years, about 1 year to about 30 years, about 1 year to about 25 years, about 1 year to about 20 years, about 1 year to about 15 years, about 1 year to about 10 years, about 1 year to about 5 years, about 5 years to about 60 years, about 5 years to about 55 years, about 5 years to about 50 years, about 5 years to about 45 years, about 5 years to about 40 years, about 5 years to about 35 years, about 5 years to about 30 years, about 5 years to about 25 years, about 5 years to about 20 years, about 5 years to about 15 years, about 5 years to about 10 years, about 10 years to about 60 years, about 10 years to about 55 years, about 10 years to about 50 years, about 10 years to about 45 years, about 10 years to about 40 years, about 10 years to about 35 years, about 10 years to about 30 years, about 10 years to about 25 years, about 10 years to about 20 years, about 10 years to about 15 years, about 15 years to about 60 years, about 15 years to about 55 years, about 15 years to about 50 years, about 15 years to about 45 years, about 15 years to about 40 years, about 15 years to about 35 years, about 15 years to about 30 years, about 15 years to about 25 years, about 15 years to about 20 years, about 20 years to about 60 years, about 20 years to about 55 years, about 20 years to about 50 years, about 20 years to about 45 years, about 20 years to about 40 years, about 20 years to about 35 years, about 20 years to about 30 years, about 20 years to about 25 years, about 25 years to about 60 years, about 25 years to about 55 years, about 25 years to about 50 years, about 25 years to about 45 years, about 25 years to about 40 years, about 25 years to about 35 years, about 25 years to about 30 years, about 30 years to about 60 years, about 30 years to about 55 years, about 30 years to about 50 years, about 30 years to about 45 years, about 30 years to about 40 years, about 30 years to about 35 years, about 35 years to about 60 years, about 35 years to about 55 years, about 35 years to about 50 years, about 35 years to about 45 years, about 35 years to about 40 years, about 40 years to about 60 years, about 40 years to about 55 years, about 40 years to about 50 years, about 40 years to about 45 years, about 45 years to about 60 years, about 45 years to about 55 years, about 45 years to about 50 years, about 50 years to about 60 years, about 50 years to about 55 years, or about 55 years to about 60 years).

In some embodiments of these methods, each of the one or two or more doses are administered at a dosage of about 0.01 mg of each common gamma-chain family cytokine receptor activating agent/kg to about 10 mg of each common gamma-chain family cytokine receptor activating agent/kg (e.g., about 0.01 mg/kg to about 9 mg/kg, about 0.01 mg/kg to about 8 mg/kg, about 0.01 mg/kg to about 7 mg/kg, about 0.01 mg/kg to about 6 mg/kg, about 0.01 mg/kg to about 5 mg/kg, about 0.01 mg/kg to about 4 mg/kg, about 0.01 mg/kg to about 3 mg/kg, about 0.01 mg/kg to about 2 mg/kg, about 0.01 mg/kg to about 1 mg/kg, about 0.01 mg/kg to about 0.5 mg/kg, about 0.01 mg/kg to about 0.1 mg/kg, about 0.01 mg/kg to about 0.05 mg/kg, about 0.05 mg/kg to about 10 mg/kg, about 0.05 mg/kg to about 9 mg/kg, about 0.05 mg/kg to about 8 mg/kg, about 0.05 mg/kg to about 7 mg/kg, about 0.05 mg/kg to about 6 mg/kg, about 0.05 mg/kg to about 5 mg/kg, about 0.05 mg/kg to about 4 mg/kg, about 0.05 mg/kg to about 3 mg/kg, about 0.05 mg/kg to about 2 mg/kg, about 0.05 mg/kg to about 1 mg/kg, about 0.05 mg/kg to about 0.5 mg/kg, about 0.05 mg/kg to about 0.1 mg/kg, about 0.1 mg/kg to about 10 mg/kg, about 0.1 mg/kg to about 9 mg/kg, about 0.1 mg/kg to about 8 mg/kg, about 0.1 mg/kg to about 7 mg/kg, about 0.1 mg/kg to about 6 mg/kg, about 0.1 mg/kg to about 5 mg/kg, about 0.1 mg/kg to about 4 mg/kg, about 0.1 mg/kg to about 3 mg/kg, about 0.1 mg/kg to about 2 mg/kg, about 0.1 mg/kg to about 1 mg/kg, about 0.1 mg/kg to about 0.5 mg/kg, about 0.5 mg/kg to about 10 mg/kg, about 0.5 mg/kg to about 9 mg/kg, about 0.5 mg/kg to about 8 mg/kg, about 0.5 mg/kg to about 7 mg/kg, about 0.5 mg/kg to about 6 mg/kg, about 0.5 mg/kg to about 5 mg/kg, about 0.5 mg/kg to about 4 mg/kg, about 0.5 mg/kg to about 3 mg/kg, about 0.5 mg/kg to about 2 mg/kg, about 0.5 mg/kg to about 1 mg/kg, about 1 mg/kg to about 10 mg/kg, about 1 mg/kg to about 9 mg/kg, about 1 mg/kg to about 8 mg/kg, about 1 mg/kg to about 7 mg/kg, about 1 mg/kg to about 6 mg/kg, about 1 mg/kg to about 5 mg/kg, about 1 mg/kg to about 4 mg/kg, about 1 mg/kg to about 3 mg/kg, about 1 mg/kg to about 2 mg/kg, about 2 mg/kg to about 10 mg/kg, about 2 mg/kg to about 9 mg/kg, about 2 mg/kg to about 8 mg/kg, about 2 mg/kg to about 7 mg/kg, about 2 mg/kg to about 6 mg/kg, about 2 mg/kg to about 5 mg/kg, about 2 mg/kg to about 4 mg/kg, about 2 mg/kg to about 3 mg/kg, about 3 mg/kg to about 10 mg/kg, about 3 mg/kg to about 9 mg/kg, about 3 mg/kg to about 8 mg/kg, about 3 mg/kg to about 7 mg/kg, about 3 mg/kg to about 6 mg/kg, about 3 mg/kg to about 5 mg/kg, about 3 mg/kg to about 4 mg/kg, about 4 mg/kg to about 10 mg/kg, about 4 mg/kg to about 9 mg/kg, about 4 mg/kg to about 8 mg/kg, about 4 mg/kg to about 7 mg/kg, about 4 mg/kg to about 6 mg/kg, about 4 mg/kg to about 5 mg/kg, about 5 mg/kg to about 10 mg/kg, about 5 mg/kg to about 9 mg/kg, about 5 mg/kg to about 8 mg/kg, about 5 mg/kg to about 7 mg/kg, about 5 mg/kg to about 6 mg/kg, about 6 mg/kg to about 10 mg/kg, about 6 mg/kg to about 9 mg/kg, about 6 mg/kg to about 8 mg/kg, about 6 mg/kg to about 7 mg/kg, about 7 mg/kg to about 10 mg/kg, about 7 mg/kg to about 9 mg/kg, about 7 mg/kg to about 8 mg/kg, about 8 mg/kg to about 10 mg/kg, about 8 mg/kg to about 9 mg/kg, or about 8 mg/kg to about 10 mg/kg of each common gamma-chain family cytokine receptor activating agent).

In some embodiments of these methods, a single or first dose of the one or more common gamma-chain family cytokine receptor activating agent(s) begins when the subject reaches an age of at least 30 years (e.g., at least 32, 34, 36, 38, 40, 42, 44, 46, 48, 50, 52, 54, 56, 58, 60, 62, 65, 70, 75, or 80 years).

In some embodiments of any of the methods described herein, the subject is not diagnosed or identified as having an aging-related disease (e.g., any of the aging-related disease or condition described herein or known in the art) or an inflammatory disease (e.g., any of the inflammatory diseases described herein or known in the art). In some embodiments of any of the methods described herein, the subject has not been previously treated with a chemotherapeutic agent (e.g., any of the chemotherapeutic agents described herein or known in the art). In some embodiments of any of the methods described herein, the subject has not been previously treated with a therapeutic agent that induces cellular senescence (e.g. any of the additional therapeutic agents that induce cellular senescence described herein).

EXAMPLES

The invention is further described in the following examples, which do not limit the scope of the invention described in the claims.

Example 1: Immunostimulation in C57BL/6 Mice Using a Multi-Chain Polypeptide Materials and Methods An exemplary multi-chain polypeptide (a type A multi-chain polypeptide described herein) was generated that includes a first polypeptide and a second polypeptide, where the first polypeptide is a soluble fusion of two TGFβRII domains, a human tissue factor 219 fragment, and a human IL-15, and the second polypeptide is a soluble fusion of two TGFβRII domains and the sushi domain of human IL-15Rα chain.

Results

Immunostimulation in C57BL/6 Mice

Figure 1A:
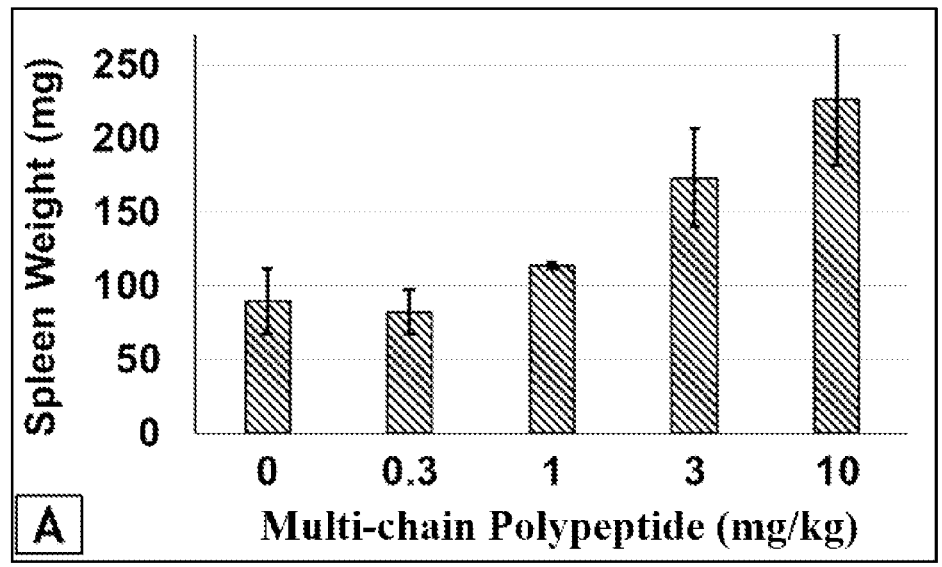
FIGS. 1A-1B show the results of immunostimulation of an exemplary multi-chain polypeptide in C57BL/6 mice.
Figure 1B:
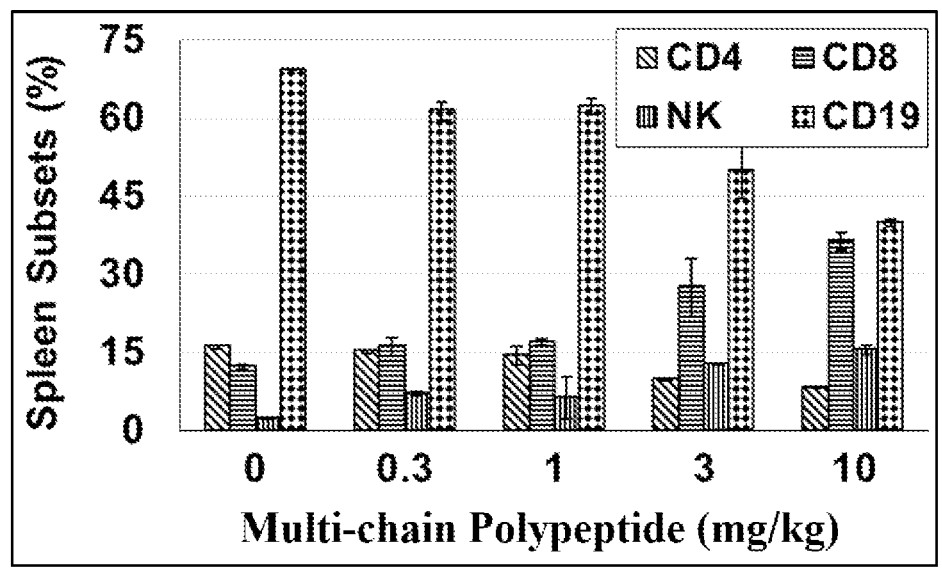

Wild type C57BL/6 mice were treated subcutaneously with either a control PBS solution or with the multi-chain polypeptide at a dosage of 0.3 mg/kg, 1 mg/kg, 3 mg/kg, or 10 mg/kg, respectively. Four days after treatment, spleen weight and the percentages of various immune cell types present in the spleen were evaluated. Specifically, single splenocyte suspensions were generated and stained with fluorochrome-conjugated antibodies including anti-CD4, anti-CD8, anti-NK1.1, and anti-CD19. The percentages of $CD4^+$ T cells, $CD8^+$ T cells, Natural Killer (NK) cells, and $CD19^+$ B cells present in the spleen of mice treated with either the control solution or the multi-chain polypeptide were evaluated using flow cytometry. As shown in FIG. 1A, the spleen weight in mice treated with the multi-chain polypeptide increased with increasing dosage of the multi-chain polypeptide. Moreover, the spleen weight in mice treated with 1 mg/kg, 3 mg/kg, and 10 mg/kg of the multi-chain polypeptide were significantly higher as compared to mice treated with the control solution, respectively. As shown in FIG. 1B, in the spleens of mice treated with the multi-chain polypeptide, the percentages of $CD8^+$ T cells and NK cells both increased with increasing dosage of the multi-chain polypeptide. Specifically, the percentages of $CD8^+$ T cells were higher in mice treated with 0.3 mg/kg, 3 mg/kg, and 10 mg/kg of the multi-chain polypeptide compared to control-treated mice, and the percentages of NK cells were higher in mice treated with 0.3 mg/kg, 1 mg/kg, 3 mg/kg, and 10 mg/kg of the multi-chain polypeptide compared to control-treated mice. These results demonstrate that the exemplary multi-chain polypeptide is able to stimulate immune cells in the spleen, in particular $CD8^+$ T cells and NK cells.

Pharmacokinetics

The pharmacokinetics of the exemplary multi-chain polypeptide were evaluated in wild type C57BL/6 mice. Mice were treated subcutaneously with the multi-chain polypeptide at a dosage of 3 mg/kg. Blood was collected at various time points via tail vein, and serum was prepared. The concentration of the multi-chain polypeptide in the serum was determined with ELISA. Briefly, the multi-chain polypeptide was captured using an anti-human tissue factor antibody, and detected using a biotinylated anti-human TGFβ receptor, a peroxidase conjugated streptavidin, and ABTS substrate. The results showed that the half-life of the exemplary multi-chain polypeptide was 12.66 hours.

Immunostimulation Over Time in C57BL/6 Mice

Figure 2A:
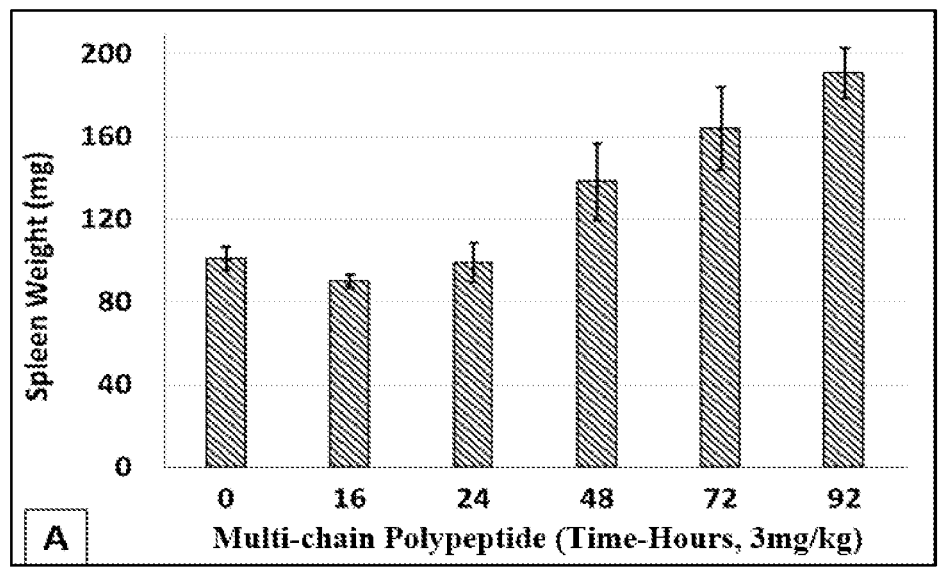
FIGS. 2A-2B show the duration of immunostimulation of an exemplary multi-chain polypeptide in C57BL/6 mice.
Figure 2B:
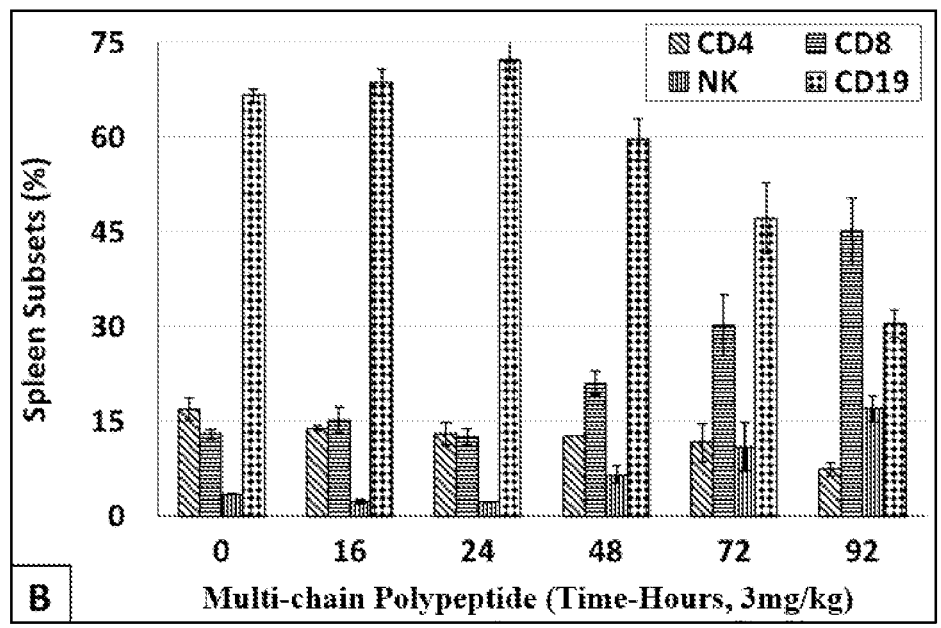

To evaluate the effect of immunostimulation by the multi-chain polypeptide over time, mice were treated with a single dose of the multi-chain polypeptide at 3 mg/kg and the spleen weight and percentages of immune cell types present in the spleen were evaluated immediately upon treatment and at 16, 24, 48, 72, and 92 hours after treatment, using techniques described above. As shown in FIG. 2A, the spleen weight of mice treated with the multi-chain polypeptide increased at 48 hours after treatment, and continued to increase over the next 44 hours. Moreover, as shown in FIG. 2B, in the spleens of mice treated with the multi-chain polypeptide, the percentages of $CD8^+$ T cells and NK cells both increased at 48 hours after treatment and continued to increase over the next 44 hours. These results further demonstrate that the exemplary multi-chain polypeptide is able to stimulate immune cells in the spleen, in particular $CD8^+$ T cells and NK cells, over time.

Figure 3A:
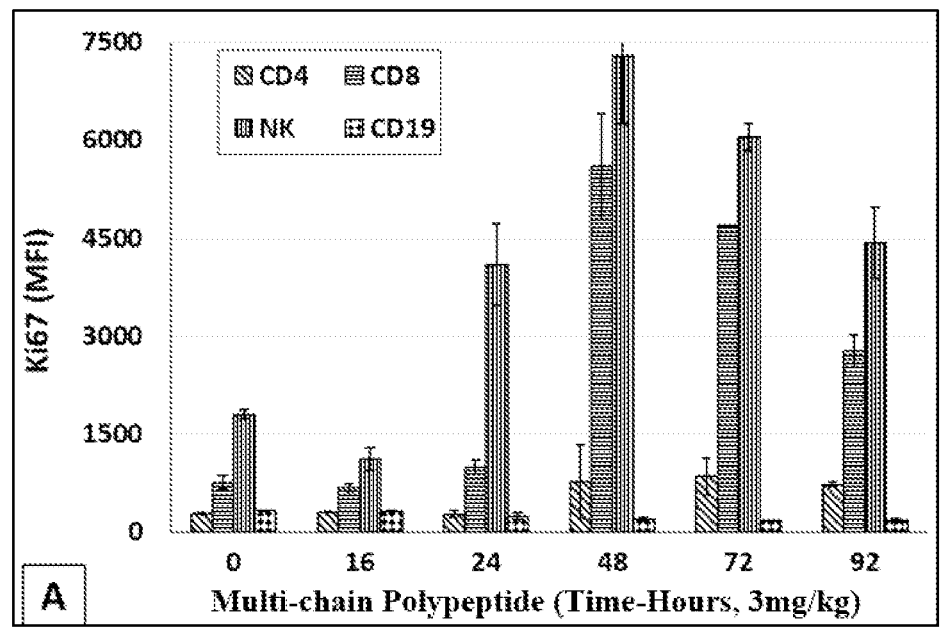
FIGS. 3A-3B show the expression of Ki67 and Granzyme B in immune cells induced by the exemplary multi-chain polypeptide.
Figure 3B:
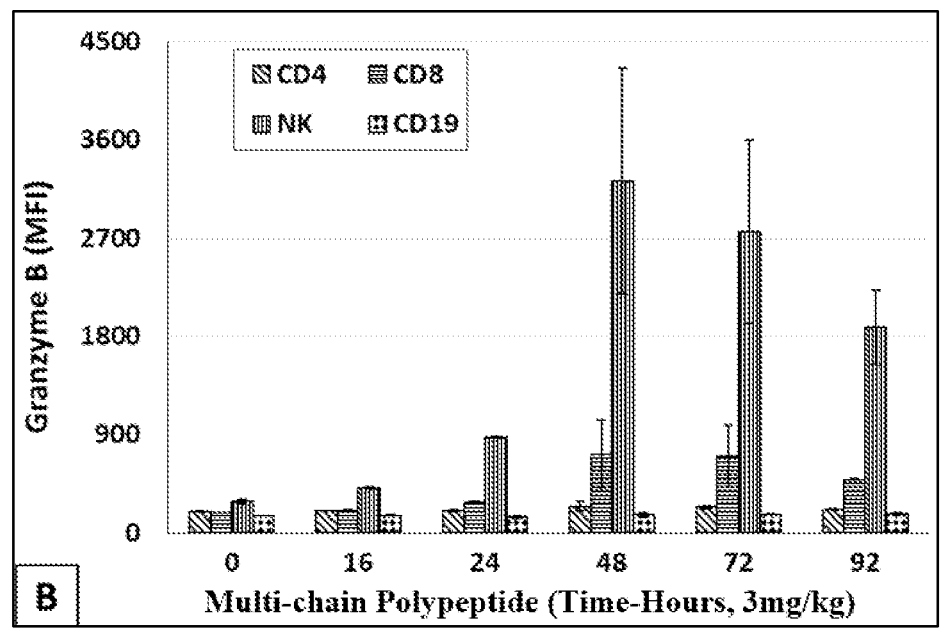

Increased Proliferation and Granzyme B Expression by $CD8^+$ T Cells and NK Cells To evaluate the proliferation and cytotoxic potential of the immune cells induced by the multi-chain polypeptide, mice were treated with a single dose of the multi-chain polypeptide at 3 mg/kg, and the spleens of these mice were evaluated immediately after, and at 16, 24, 48, 72, and 92 hours after treatment. Briefly, single splenocyte suspensions were generated and stained with fluorochrome-conjugated antibodies for the various cell types including anti-CD4, anti-CD8, anti-NK1.1, and anti-CD19, and with an anti-Ki67 antibody (i.e. a cell proliferation marker) and an anti-Granzyme B antibody (i.e. a cytotoxic marker). The mean fluorescent intensity (MFI) of Ki67 and Granzyme B for each immune cell type was analyzed by flow cytometry. As shown in FIGS. 3A and 3B, the expression of Ki67 and Granzyme B by NK cells showed an increase at 24 hours as well as each time point evaluated thereafter as compared to immediately after treatment (0 hours). Moreover, the expression of Ki67 and Granzyme B by $CD8^+$ T cells showed an increase at 48 hours as well as each time point evaluated thereafter as compared to immediately after treatment (0 hours). As such, a single dose of the multi-chain polypeptide resulted in proliferation of $CD8^+$ T cells and NK cells for up to at least 4 days post-treatment.

These results demonstrate that the multi-chain polypeptide not only increased the number of $CD8^+$ T cells and NK cells in the spleen, but also enhanced the proliferation and cytotoxicity of these cells.

Cytotoxicity Against Tumor Cells

Next, the cytotoxicity of the splenocytes activated by the multi-chain polypeptide against tumor cells were evaluated in C57BL/6 mice. Mouse Moloney leukemia cells (Yac-1) were labeled with CellTrace Violet and used as tumor target cells. C57BL/6 mice were treated with a single dose of the multi-chain polypeptide at 3 mg/kg, and splenocytes were prepared at various time points thereafter and used as effector cells. The target tumor cells were mixed with the effector cells at an effector:target (E:T) ratio of 10:1, and incubated at 37° C. for 20 hours. Target cell viability was assessed by analyzing Propidium Iodide (PI)-positive, CellTrace Violet-labeled Yac-1 cells using flow cytometry. The percentage of Yac-1 tumor inhibition was calculated using the formula:

Percentage of Yac-1 tumor inhibition=(1−viable Yac-1 cell number in experimental sample/viable Yac-1 cell number in the sample without splenocytes)×100

Figure 4:
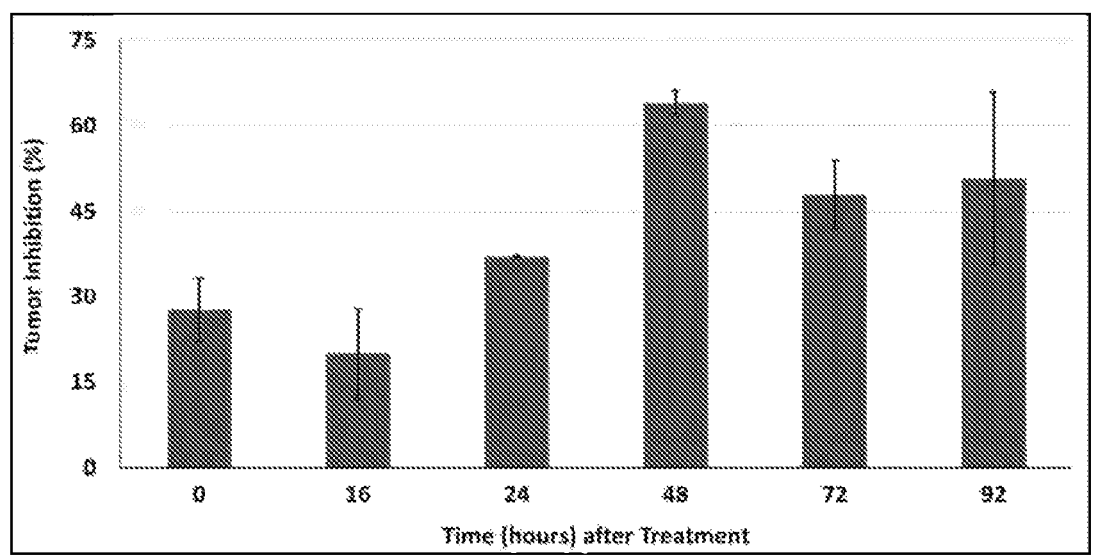
FIG. 4 shows the effect of tumor inhibition by splenocytes prepared from mice treated with an exemplary multi-chain polypeptide at various time points after treatment.

As shown in FIG. 4, splenocytes from mice after 24-hour or more treatment with the multi-chain polypeptide showed increased cytotoxicity against Yac-1 cells as compared to the splenocytes from untreated mice.

Example 2: Immunostimulation in C57BL/6 Mice Using a High Fat Diet-Based Type-2 Diabetes Mouse Model Materials and Methods TGFRt15-TGFRs is a multi-chain chimeric polypeptide (a type A multi-chain chimeric polypeptide described herein) that includes two TGFβ-binding domains which a soluble human TGFβRII dimer (aa24-159). 21t15-TGFRs is a multi-chain chimeric polypeptide (a type A multi-chain chimeric polypeptide described herein) that includes IL-21 and a TGFβ-binding domain. 2t2 is a chimeric polypeptide (a type B chimeric polypeptide described herein) that include two IL-2 polypeptides.

Results

To evaluate the effect of TGFRt15-TGFRs, 2t2, and 21t15-TGFRs in treating Type-2 diabetes, a high fat diet-based Type-2 diabetes mouse model (B6.129P2-ApoE$^{tm1Unc}$/J from The Jackson Laboratory) was used. Mice were fed either a control diet or a high fat diet for 11 weeks. A subset of mice fed with the high fat diet were also treated with TGFRt15-TGFRs, 2t2, or 21t15-TGFRs. Mice fed the control diet, high fat diet, and mice fed with the high fat diet and treated with TGFRt15-TGFRs, 2t2, or 21t15-TGFRs were evaluated 4 days post-treatment. Briefly, single splenocyte suspensions were generated and stained with fluorochrome-conjugated antibodies including anti-CD4, anti-CD8, anti-NK1.1, and anti-CD19. The percentages of CD4$^+$ T cells, CD8$^+$ T cells, Natural Killer (NK) cells, and CD19$^+$ B cells present in the spleen of mice in each group were evaluated using flow cytometry.

Figure 5A:
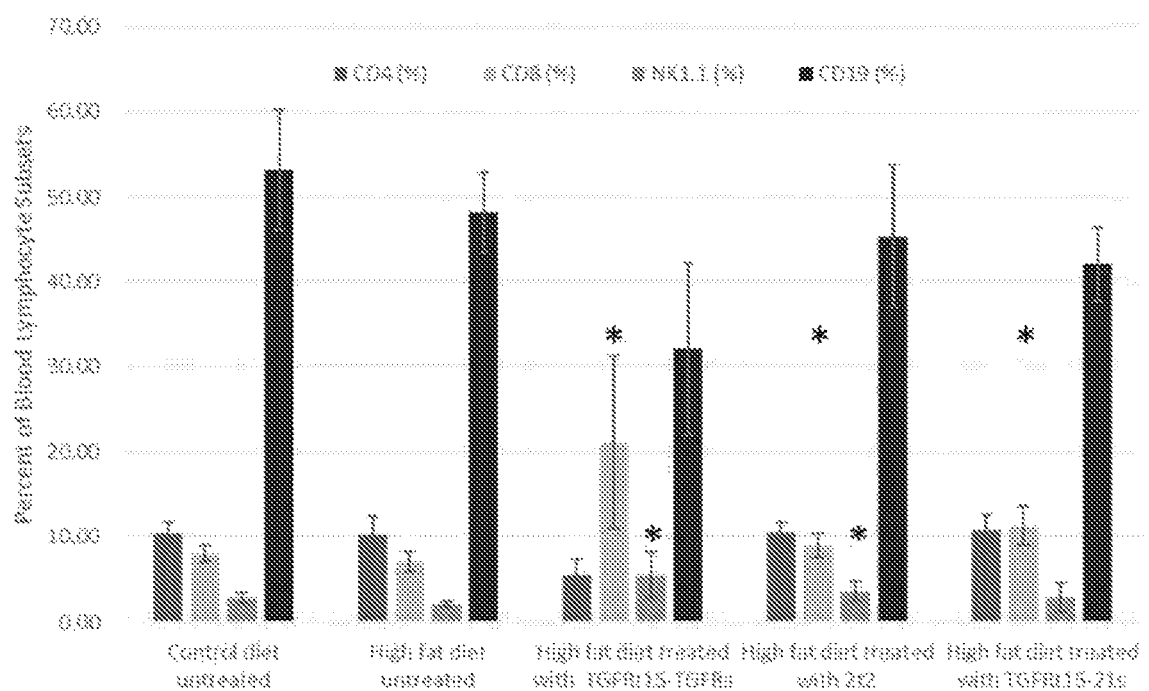
FIGS. 5A-5B show the percentages and the proliferation rate of CD4$^+$ T cells, CD8$^+$ T cells, Natural Killer (NK) cells, and CD19$^+$ B cells in the blood of B6.129P2-ApoE$^{tm1Unc}$/J mice (purchased from The Jackson Laboratory) fed a control diet, a high fat diet and untreated, and mice fed a high fat diet and treated with TGFRt15-TGFRs, 2t2, or 21t15-TGFRs.
Figure 5B:
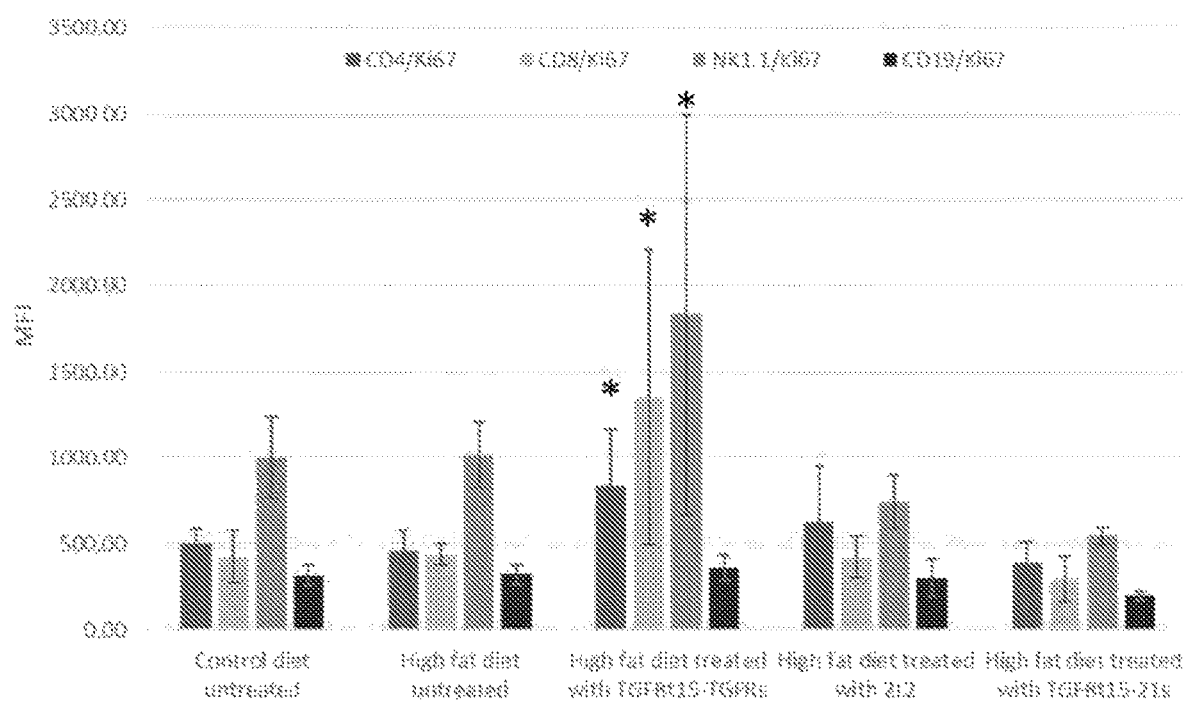

As shown in FIG. 5A, in mice fed a high fat diet, the percentage of NK cells in PBMCs was significantly increased after treatment with TGFRt15-TGFRs or 2t2 compared to untreated mice, but not after treatment with 21t15-TGFRs. Furthermore, the percentage of CD8$^+$ T cells in PBMCs was significantly increased after treatment with TGFRt15-TGFRs, 2t2, or 21t15-TGFRs compared to untreated mice. Moreover, the proliferation of CD4$^+$ T cells, CD8$^+$ T cells, Natural Killer (NK) cells, and CD19$^+$ B cells in PBMCs were also evaluated using an anti-Ki67 antibody. As shown in FIG. 5B, the number of proliferating NK cells, CD4$^+$ T cells, and CD8$^+$ T cells were significantly increased after treatment with TGFRt15-TGFRs, but not after treatment with 2t2 or 21t15-TGFRs.

Figures 6A, 6B, 6C, 6D, 6E:
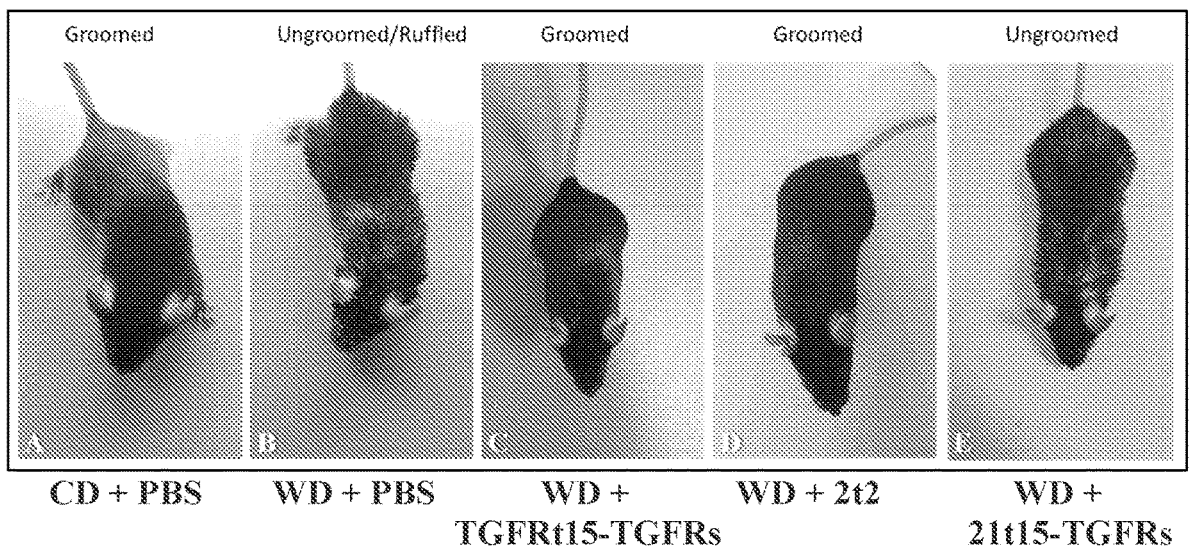
FIGS. 6A-6E show exemplary physical appearance of mice fed either a control or high fat diet and were either untreated or treated with TGFRt15-TGFRs, 2t2, or 21t15-TGFRs.

To examine the effect of TGFRt15-TGFRs, 2t2 and 21t15-TGFRs on the appearance and texture of skin and hair in animals, mice were fed either a control or a high fat diet for 7 weeks, and a subset of the mice fed a high fat diet were also treated with TGFRt15-TGFRs, 2t2 or 21t15-TGFRs. One week post-treatment, the appearance of the mice was evaluated. Mice fed a high fat diet and untreated, or a high diet and treated with 21t15-TGFRs appeared ungroomed and ruffled, and had increased gray hair/hair loss as compared to mice fed a control diet (FIGS. 6A, 6B and 6E). Surprisingly, mice fed a high fat diet that received TGFRt15-TGFRs or 2t2 treatment appeared groomed and healthier (less gray hair/hair loss) (FIGS. 6C and 6D) as compared to mice fed a high fat diet that did not receive TGFRt15-TGFRs or 2t2 treatment (FIG. 6B). Specifically, TGFRt15-TGFRs or 2t2-treated mice showed superior skin and hair appearance and texture as compared to control mice. These results demonstrate that treatment with TGFRt15-TGFRs or 2t2 improves the appearance and texture of skin and hair in mammals.

Figure 7:
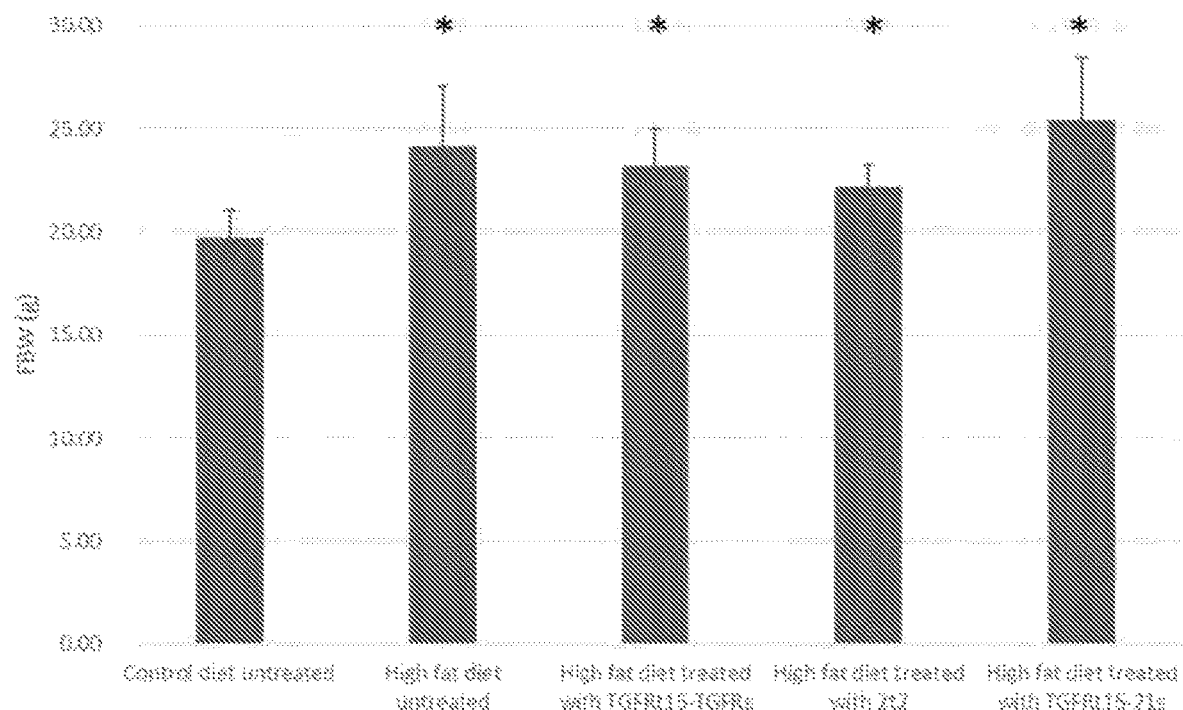
FIG. 7 shows the fasting body weight of mice fed either a control or a high fat diet and were either untreated or treated with TGFRt15-TGFRs, 2t2, or 21t15-TGFRs.

Next, mice were fed either a control or high fat diet for 9 weeks, and a subset of the mice fed a high fat diet were treated with TGFRt15-TGFRs, 2t2, or 21t15-TGFRs. Four days post-treatment, the fasting body weight of mice in each group were measured. The fasting body weight of mice fed with the high fat diet and untreated, as well as mice fed with the high fat diet and treated with 21t15-TGFRs were significantly increased compared to mice fed a control diet. However, the fasting body weight of mice fed a high fat diet and treated with TGFRt15-TGFRs or 2t2 were decreased compared to the other two high fat diet groups mentioned above. The fasting body weight of the mice at the end of the study (9 weeks) is shown in FIG. 7.

Figure 8:
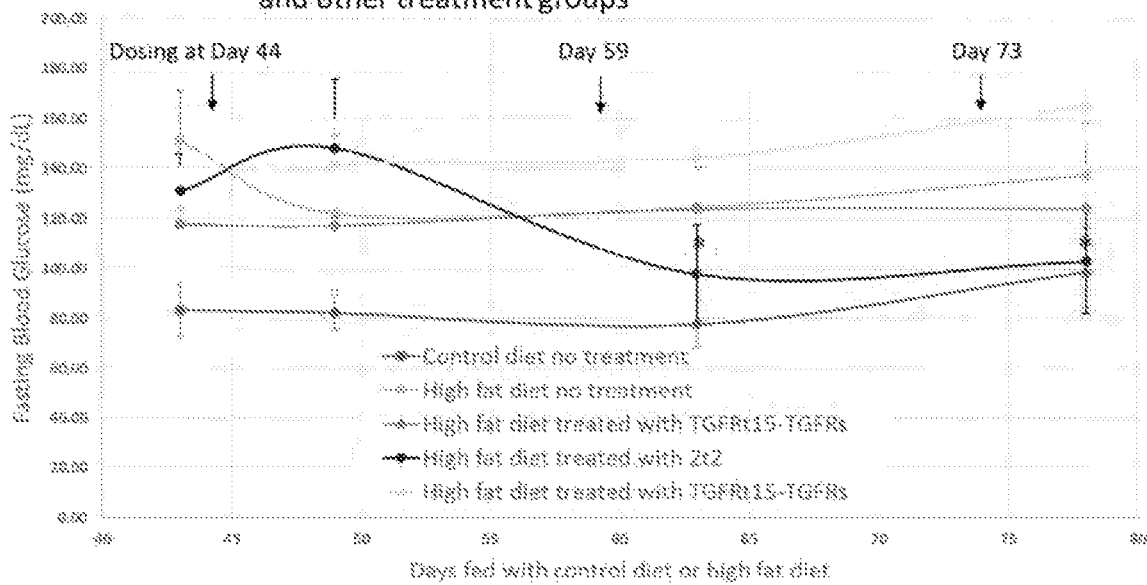
FIG. 8 shows the fasting blood glucose levels of mice fed either a control or a high fat diet and were either untreated or treated with TGFRt15-TGFRs, 2t2, or 21t15-TGFRs.

To evaluate the fasting glucose levels in the mice of each group, mice were fed either a control or a high fat diet and were either untreated or treated with TGFRt15-TGFRs, 2t2, or 21t15-TGFRs on days 44, 59 and 73. The fasting blood glucose in the mice of each group were measured 4 days post-treatment. As shown in FIG. 8, after the second and third doses (on Days 59 and 73, respectively), the fasting blood glucose level was significantly reduced for mice fed a high fat diet and treated with 2t2 as compared to mice fed a high fat diet but untreated. The fasting blood glucose level remained constant for mice fed a high fat diet and treated with TGFRt15-TGFRs, whereas the fasting blood glucose level increased for mice fed a high fat diet and treated with 21t15-TGFRs.

Example 3: Chemotherapy-Induced Senescent B16F10 Melanoma Cells Express NK Ligands Material and Methods Cellular senescence in B16F10 melanoma cells was induced by treating the cells with docetaxel (7.5 µM, Sigma) for 3 days followed by recovery in complete media for 4 days. Cellular senescence was accessed by staining the cells with senescence-associated β-galactosidase (SA (3-gal). Briefly, B16F10 control and senescence cells (B16F10-SNC) were washed once with PBS, fixed with 0.5% glutaraldehyde (PBS (pH 7.2)), for 30 minutes. Cells were stained in X-gal solution (1 mg/mL X-gal, 0.12 mM K$_3$Fe[CN]$_6$, 0.12 mM K$_4$Fe[CN]$_6$, and 1 mM MgCl$_2$ in PBS at pH 6.0) overnight at 37° C., and were imaged using a Nikon optical light microscope.

Results

Figures 9A, 9B, 9C, 9D, 9E, 9F:
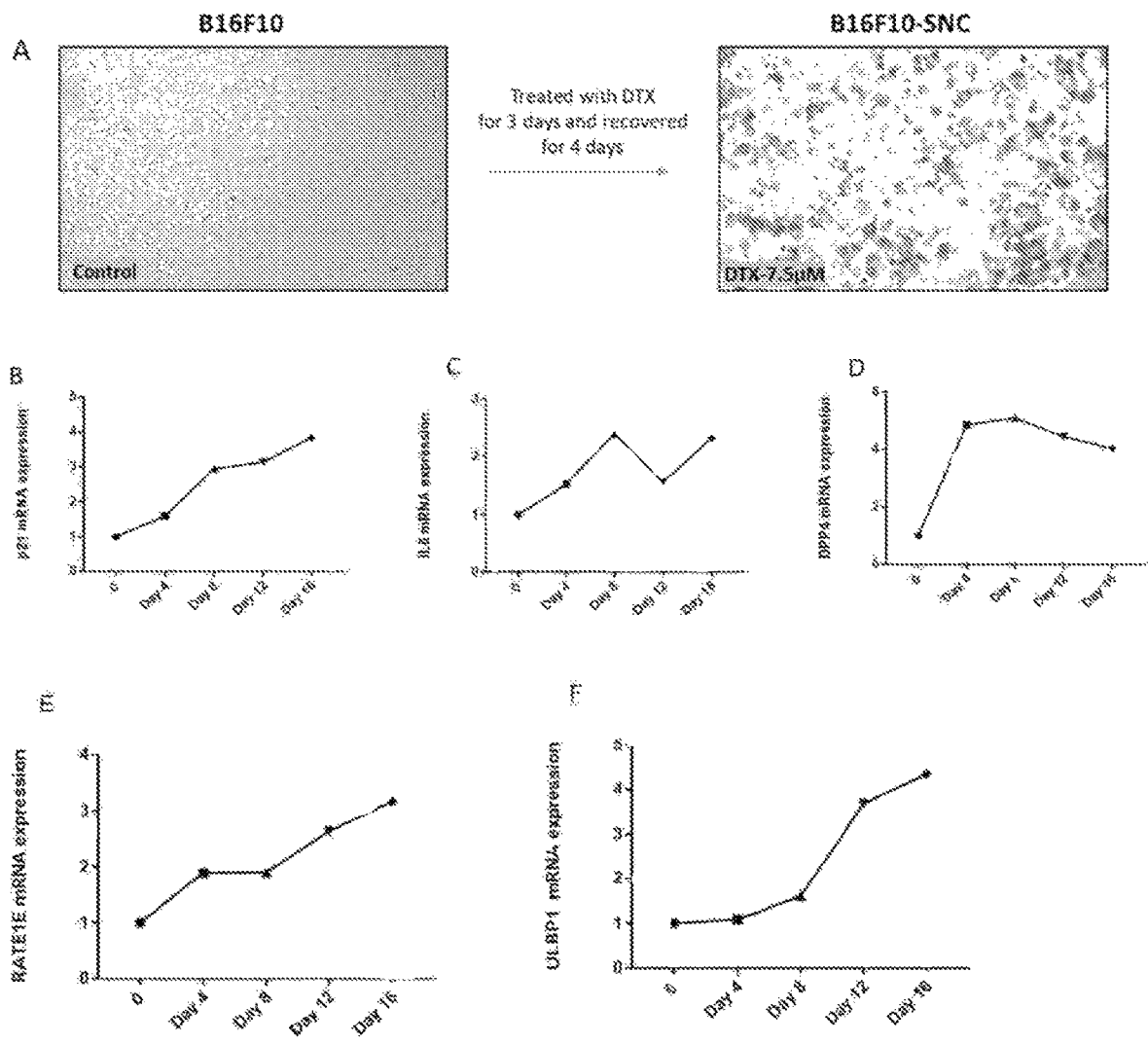
FIGS. 9A-9F show chemotherapy-induced senescent B16F10 cells and expression of senescent genes.

Cellular senescence in B16F10 melanoma cells was induced using chemotherapy as described above. As shown in FIG. 9A, chemotherapy-induced senescent B16F10 cells (B16F10-SNC) were positive for SA β-gal staining, while the control B16F10 cells were not stained. Next, expression of senescence genes was analyzed using RT-qPCR with RNA isolated on day 0 or following senescence induction on days 4, 8, 12 and 16, respectively. The expression levels were normalized to control B16F10 cells. As shown in FIGS. 9B-9D, the expression of p21, IL6 and DPP4 were upregulated in RNA isolated from the senescent cells over the duration of the experiment. Moreover, as shown in FIGS. 9E and 9F, the expression of RATE1E and ULBP1 (NK activating receptor NKG2D ligands) were also induced in senescent cells, with the highest expression level being on day 16. These results demonstrate that the chemotherapy-induced senescent B16F10 cells are subjected to stronger cytotoxicity of activated NK cells than control B16F10 cells.

Figures 10A, 10B, 10C, 10D, 10E, 10F:
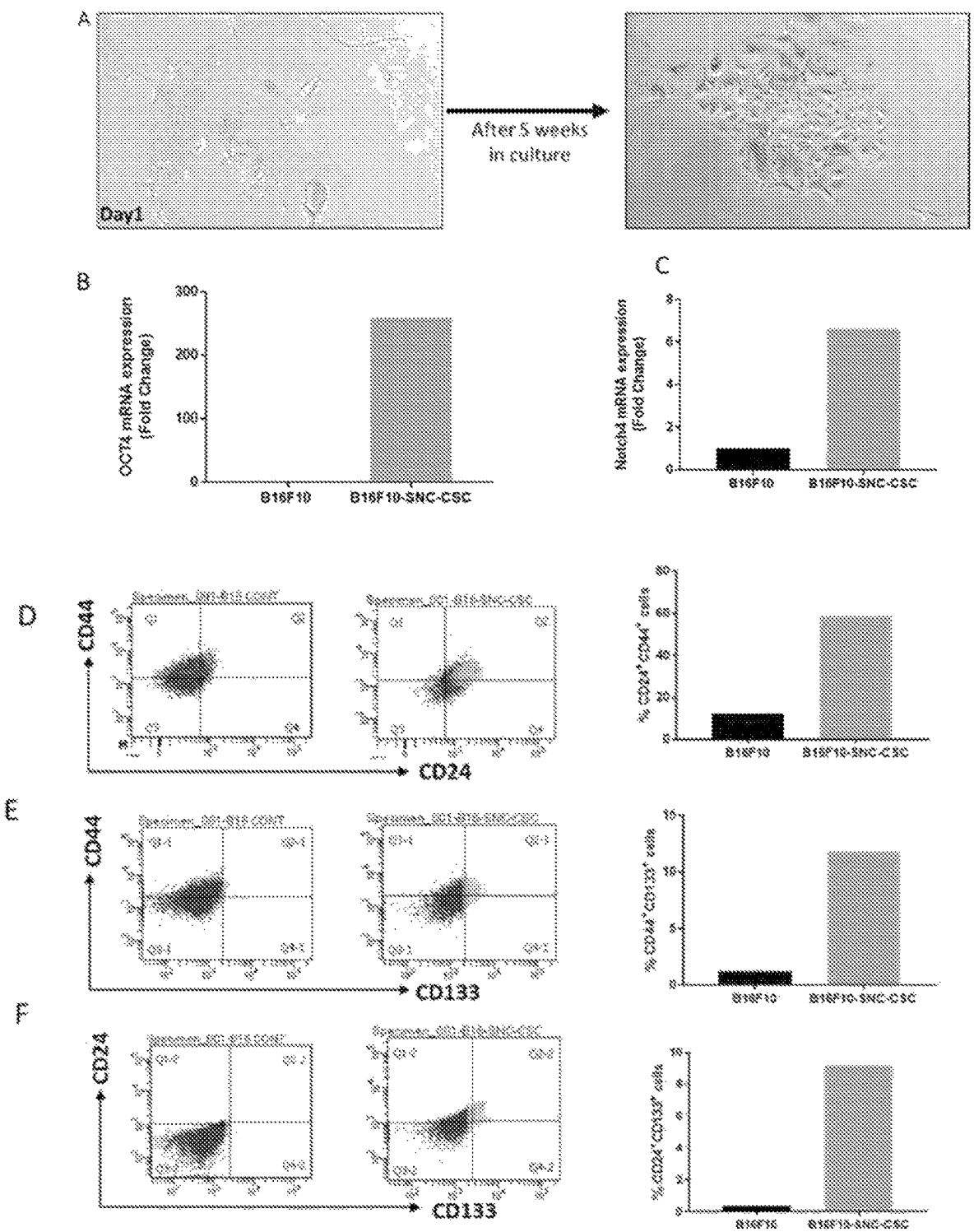
FIGS. 10A-10F show colony formation and expression of stem cell markers by chemotherapy-induced senescent B16F10 cells.

Acquisition of Stem-cell Properties in Chemotherapy-Induced Senescent B16F10 Melanoma Cells To examine whether chemotherapy-induced senescent B16F10 melanoma cells acquired stem cell properties, a colony formation assay was performed. Briefly, 1000 cells/well were seeded on a six well plate, and the media was changed every third day. As shown in FIG. 10A (images taken at 100× magnification), after 5 weeks in culture the senescent cells were able to form colonies. To evaluate stem cell marker expression by the colonies, RNA was isolated from the colonies and the expression of Oct4 and Notch4 mRNA were determined by RT-qPCR. As compared to control B16F10 cells, chemotherapy-induced senescent B16F10 melanoma cells showed upregulation of Oct4 and Notch 4, which are cancer stem cell markers (FIGS. 10B and 10C). Moreover, cell surface expression of stem cell markers CD44, CD24 and CD133 were evaluated by staining with antibodies against CD44, CD24, and CD133 followed by flow cytometry. As shown in FIGS. 10D-10F, double positive populations (CD44$^+$CD24$^+$, CD44$^+$CD133$^+$, and CD24+CD133+) were increased in the chemotherapy induced senescence stem cells (B16F10-SNC-CSC) compared to control B16F10.

Figures 11A, 11B, 11C:
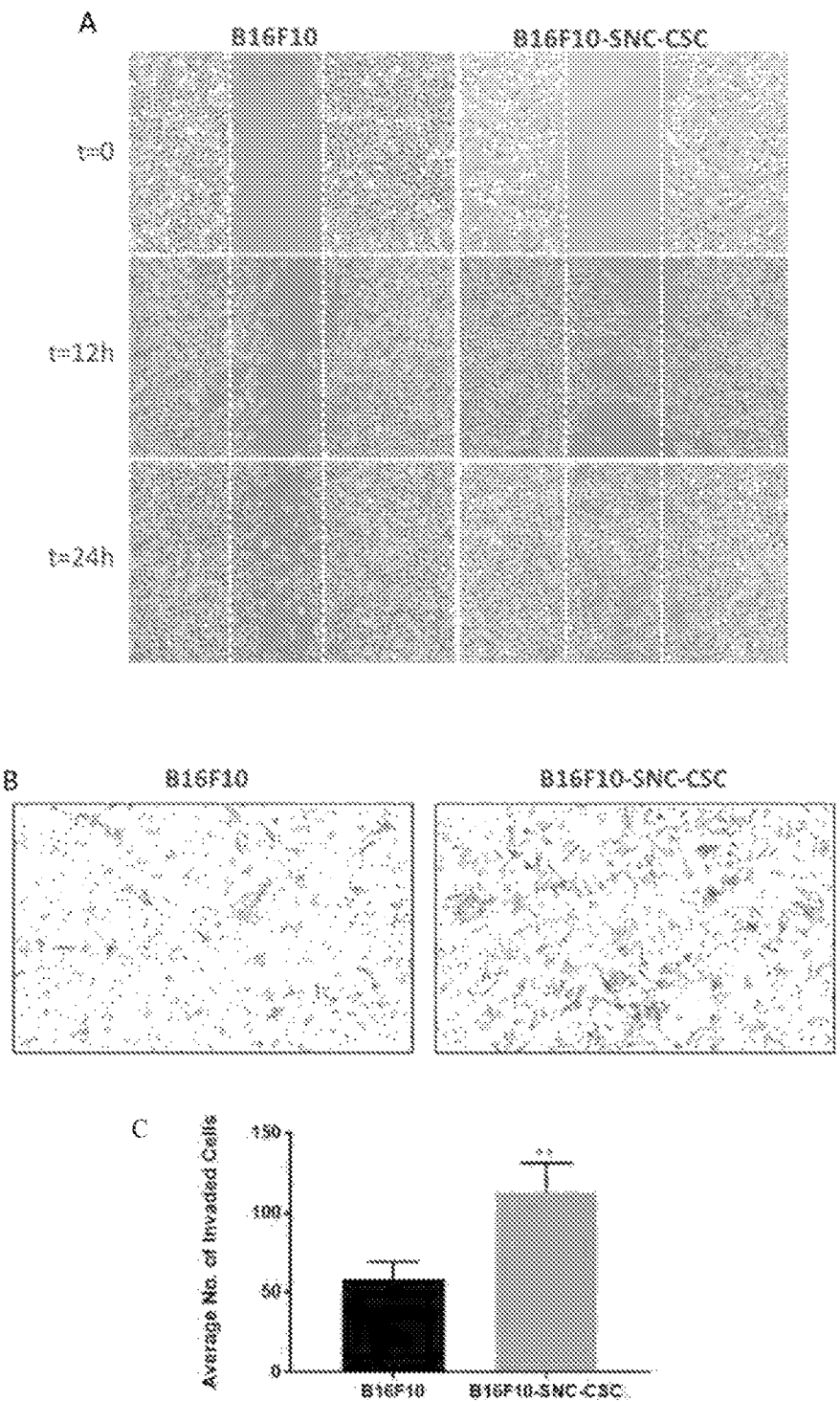
FIGS. 11A-11C show migratory and invasive properties of chemotherapy-induced senescent B16F10 cells.

Chemotherapy-Induced Senescent (CIS) Melanoma Cells with Stem Cell Properties are More "Migratory" and "Invasive" than Control B16F10 Cells The migratory properties of chemotherapy-induced senescent (CIS) melanoma cells with stem cell properties (B16F10-SNC-CSC) were analyzed using a migration assay. Briefly, control B16F10 cells and B16F10-SNC-CSC cells were plated on six well plates and wounded with a p20 pipette tip. Movement of cells were imaged at 0, 12, and 24 hours after. As shown in FIG. 11A, chemotherapy-induced senescent (CIS) melanoma cells with stem cell properties (B16F10-SNC-CSC) were more migratory in the in vitro migration assay, as compared to control B16F10 cells.

Next, the invasive properties of chemotherapy-induced senescent cells with stem cell properties (B16F10-SNC-CSC) were analyzed using an invasion assay. The invasion assay was carried out on 24-well transwell inserts coated with Matrigel. Briefly, 0.5×10⁶ control B16F10 cells and B16F10-SNC-CSC cells were seeded in serum-free media onto the upper chamber, and the lower chamber was filled with media supplemented with 10% FBS. After 16 hours of incubation, the cells on the upper surface of the filter were removed, and cells underneath the filter were fixed and stained with a 0.02% crystal violet solution. The number of cells were counted in three fields at 100× magnification. As shown in FIGS. 11B and 11C, chemotherapy-induced senescent cells with stem cell properties were more aggressive in invading the Matrigel coated membrane as compared to control B16F10 cells. These results demonstrate that chemotherapy-induced senescent B16F10 tumor cells are able to regain their proliferation capability, obtain stem-cell features, and have increased migratory abilities and invasiveness for metastasis.

Figure 12A:
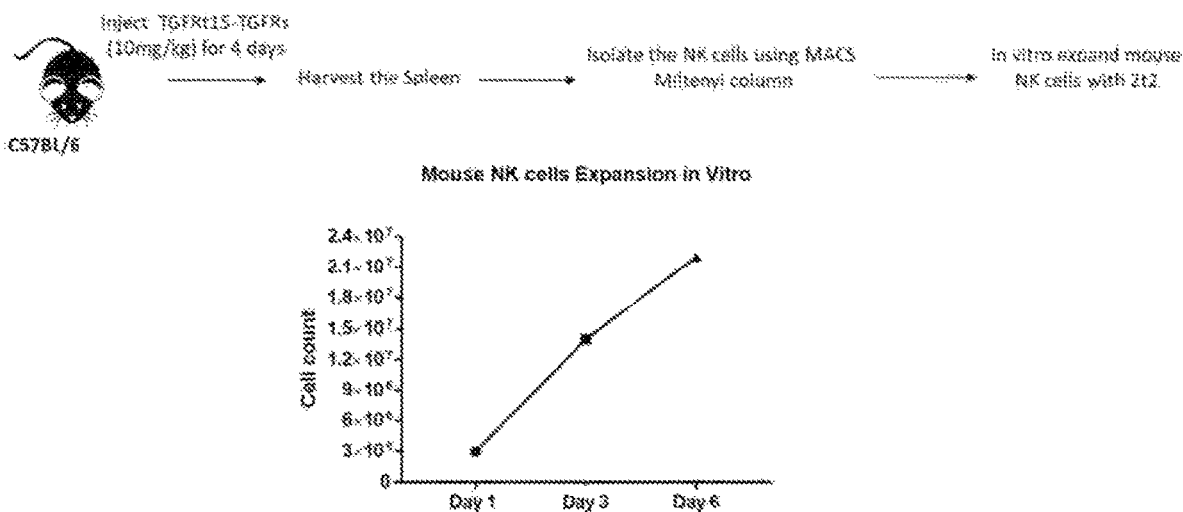
FIGS. 12A and 12B show in vitro expanded NK cells and their cytotoxicity against chemotherapy-induced senescent cells with stem cell properties (B16F10-SNC-CSC) or control B16F10 cells.

Cytotoxic Activity of Mouse NK Cells on Chemotherapy-Induced Senescent Cells with Stem Cell Properties To expand NK cells in vivo, C57BL/6 mice were injected subcutaneously with TGFRt15-TGFRs (10 mg/kg) for 4 days. The spleens from these mice were obtained and NK cells were purified using MACS Miltenyi column. The purified NK cells were then expanded in vitro with 2t2 (FIG. 12A).

Figure 12B:
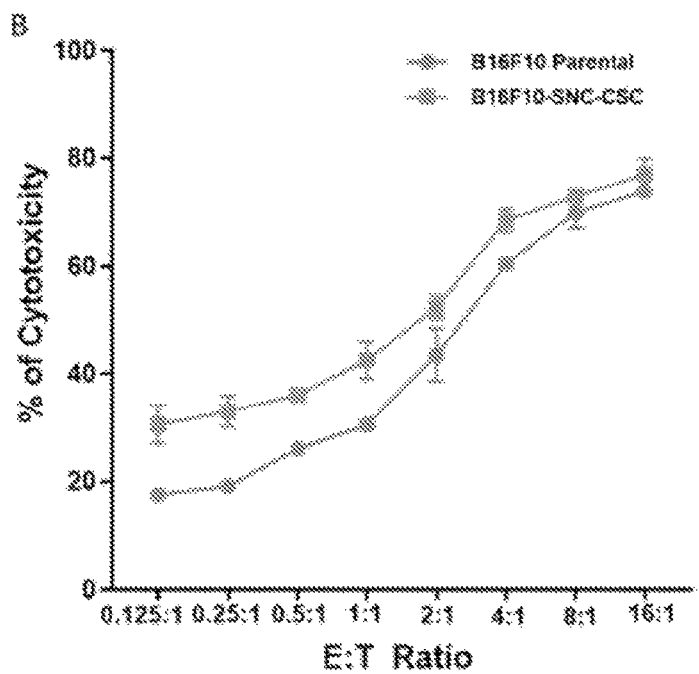

To evaluate the cytotoxicity of the expanded NK cells, chemotherapy-induced senescent stem cells (B16F10-SNC-CSC) or control B16F10 cells were labelled with CellTrace violet and incubated with in vitro activated 2t2 mouse NK cells (isolated from spleen of C57BL/6 mice injected with 10 mg/kg TGFRt15-TGFRs for 4 days) at various E:T ratios for 16 hrs. The B16F10-SNC-CSC and control B16F10 cells were trypsinized, washed and re-suspended in complete media containing a Propidium Iodide (PI) solution, and cytotoxicity was accessed by flow cytometry. As shown in FIG. 12B, NK cells were more effective at killing chemotherapy-induced senescent cells with stem cell properties (B16F10-SNC-CSC), as compared to control B16F10 cells.

Combination Treatment in Melanoma Mouse Model

Figure 13A:
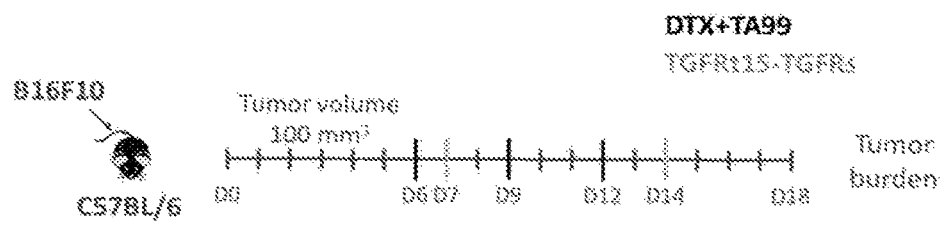
FIGS. 13A-13C show results of combination treatment using a mouse melanoma model.
Figure 13B:
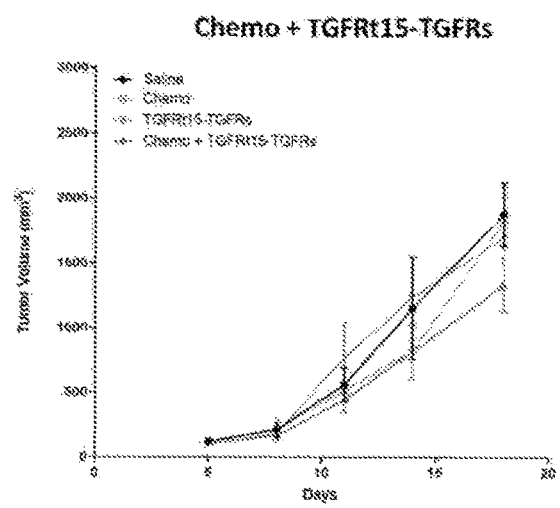
Figure 13C:
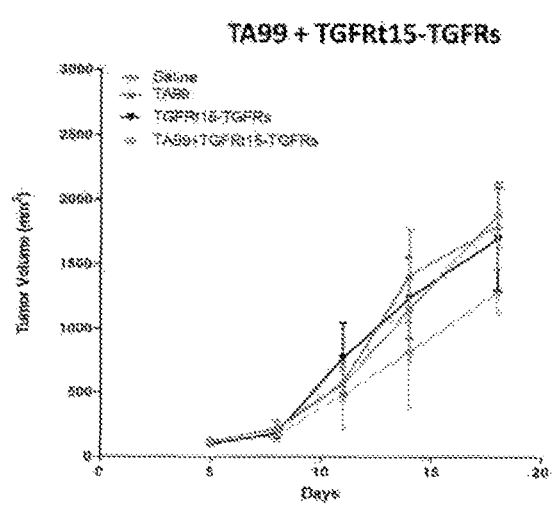

The effect of TGFRt15-TGFRs in treating melanoma was evaluated in a mouse melanoma model. Briefly, 5×10⁵ B16F10 cells were injected subcutaneously into C57BL/6 mice. When the tumor volume reached ~100 mm³, mice were treated with docetaxel (chemotherapy) (5 mg/kg) or TA99 (200 μg) either as a single agent or in combination every third day, and TGFRt15-TGFRs (3 mg/kg) was given once a week (FIG. 13A). Mice that received saline, docetaxel (chemotherapy)/TA99 alone, or TGFRt15-TGFRs alone were used as controls. Five mice were tested in each experimental and control group. Tumor volume was measured every third day. As shown in FIGS. 13B and 13C, combinations of TGFRt15-TGFRs with either chemotherapy or TA99 slowed down tumor progression as compared to mice treated with saline or mice treated with chemotherapy or TA99 alone in the syngeneic melanoma mouse model.

Example 4: Chemotherapeutic Induction of Senescence in Human Pancreatic Cell Line SW1990

Materials and Methods

β-galactosidase staining: Confirmation of chemotherapy induced senescence was carried out by standard β-galactosidase staining at pH 6.0 using commercially available kit (Cell Signaling Technology) according to manufacturer's instructions. The following day, the staining solution was removed, and cells were washed with phosphate buffered saline, and 70% glycerol was added to the wells. The β-galactosidase positive cells will be stained, while control untreated cells will not stain.

Flow cytometry: One million control and senescent cells were obtained and stained using commercially available antibodies to surface markers of stem cells such as anti-CD44 and anti-CD24 antibodies (Biolegend) according to manufacturers' instructions. The cells were then washed and analyzed using the BD Celesta flow cytometer. Cells showing stem cell-like properties will be doubly positive for both CD44 and CD24.

Gene expression assay: One million control and senescent cells were obtained and lysed using Trizol (Thermofisher), followed by RNA purification using an RNA isolation kit (Qiagen). The RNA was quantified and converted to cDNA using a Qiagen cDNA Quantitect kit. The cDNA was then used as a template for standard Taqman gene expression assays (Thermofisher) to quantify the relative abundance of senescent, stem cell markers as well as NK ligands.

NK cell cytotoxicity assay: NK cells were isolated from healthy human donors (n=2) using a commercially available NK isolation kit (Stem Cell), and were activated overnight using the cytokine fusion molecule 18t15-12s (100 nM). On the following day, NK cells were washed to remove cytokine molecules and mixed with either CellTrace Violet labelled control untreated tumor cells or chemotherapy-induced senescent tumor cells at an E:T ratio of 4:1 for 20 hours. On the following day, cells were trypsinized, and complete contents of each well were analyzed using flow cytometry and percent inhibition of cells was analyzed.

Results

Figure 14:
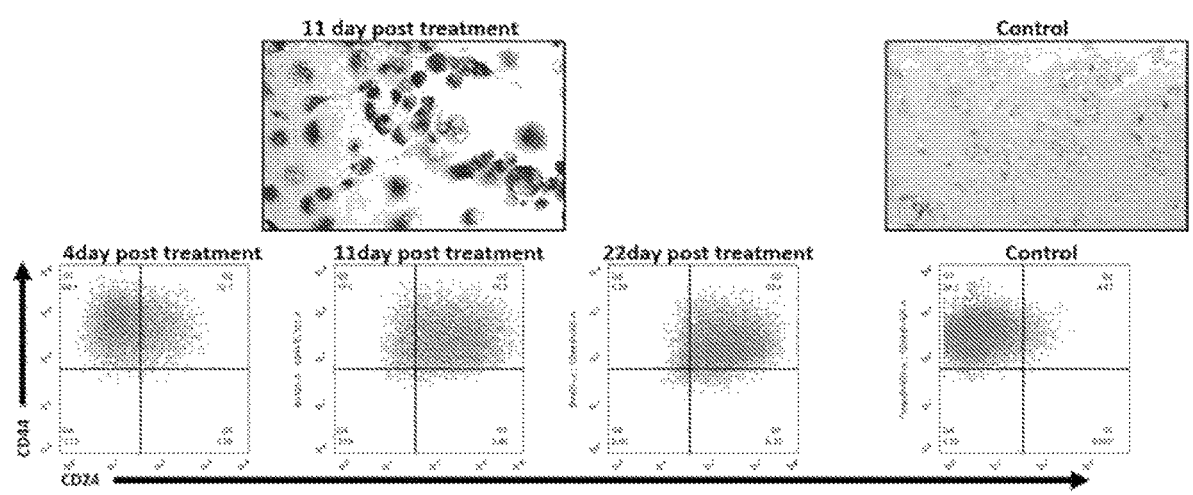
FIG. 14 shows induction of senescence in the human pancreatic tumor cell line SW1990 and expression of CD44 and CD24 in senescent SW1990 cells as compared to control SW1990 cells.
Figure 15:
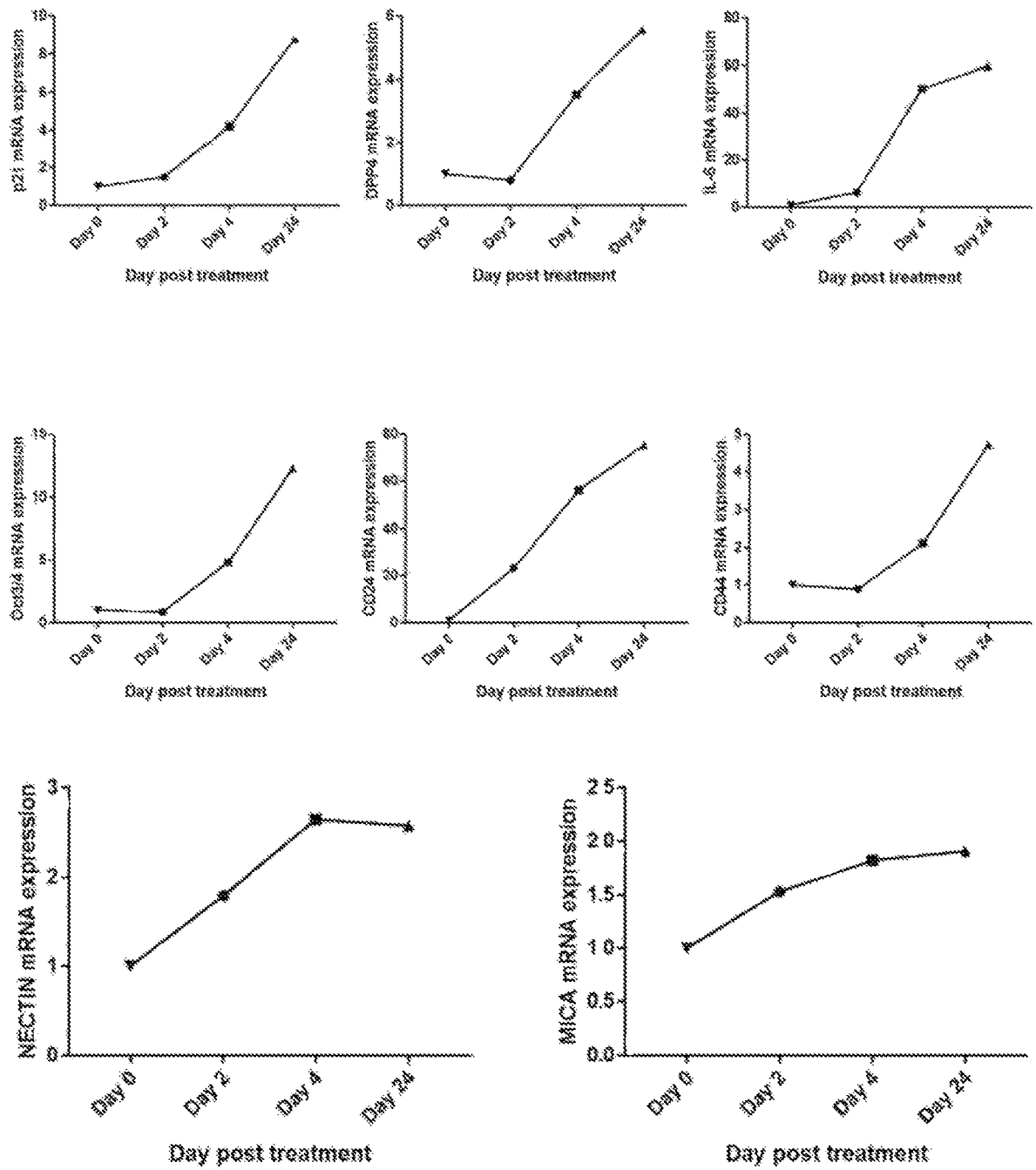
FIG. 15 shows expression of senescent markers by chemotherapy-induced senescent SW1990 cells.

Senescence in the human pancreatic tumor cell line SW1990 was induced through treatment with chemotherapeutic drugs Abraxane (Celgene) and Gemcitabine (Sigma Aldrich) for 3 days at 2.5 μM and 6.25 μM, respectively. SW1990 cells that were untreated were used as controls. Media was changed after 3 days and cells were allowed to rest in the culture media for 4 days. As shown in FIG. 14, senescent cells treated with the chemotherapeutic drugs were positive for β-galactosidase staining, while control cells were not stained. Senescent cells and control cells were evaluated for their expression of senescence and stem cell markers at 4 days, 11 days, and 22 days post-treatment. As shown in FIG. 14, senescent cells showed increased double positive staining for CD44 and CD24 over time as compared to the control cells. Moreover, the chemotherapy-induced senescent SW1990 cells were also analyzed for their expression of senescent markers including DPP4, 1L6, and p21, stem cell markers including Oct3/4, CD24, and CD44, and NK ligands including Nectin and MICA, on day 0, and days 2, 4, and 24 post-treatment using the gene expression assay described above. As shown in FIG. 15, the expression of all of the markers mentioned showed an increase over time.

Cytotoxicity of In Vitro Activated Human NK Cells

Figure 16:
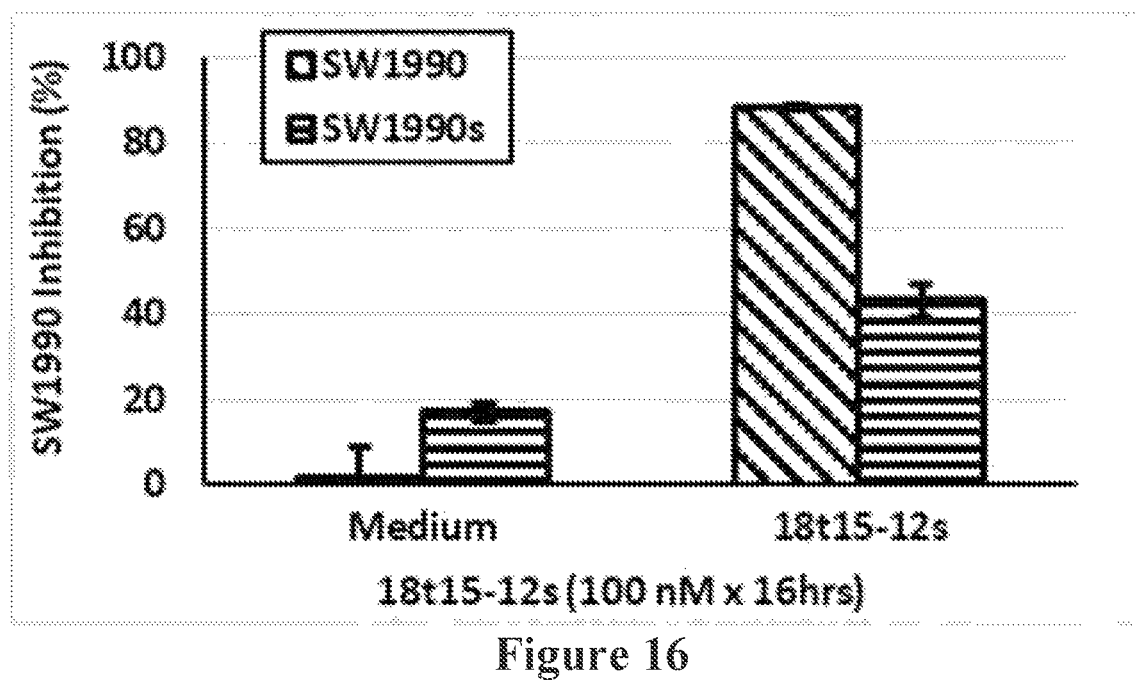
FIG. 16 shows the cytotoxicity of in vitro activated human NK cells against chemotherapy-induced senescent SW1990 cells or control SW1990 cells.

To evaluate the cytotoxicity of in vitro activated human NK Cells (treated with 18t15-12s), senescence in the human pancreatic tumor cell line SW1990 was induced through treatment with chemotherapeutic drugs Abraxane (Celgene) and Gemcitabine (Sigma Aldrich) for 3 days at 2.5 µM and 6.25 µM, respectively. SW1990 cells that were untreated were used as controls. Media was changed after 3 days and cells were allowed to rest in the culture media for 30 days. The culture media was changed every 4 days. Activated NK cells were obtained and their cytotoxicity for chemotherapy-induced senescent tumor cells and untreated control tumor cells were evaluated using the NK cell cytotoxicity assay described above. As shown in FIG. 16, activated NK cells showed increased cytotoxicity against both control SW1990 cells (SW1990) and senescent SW1990 cells (SW1990s).

Example 5: Creation of an IL-12/IL-15RαSu DNA Construct

Figure 17:
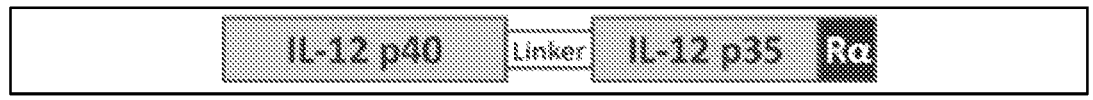
FIG. 17 shows a schematic diagram of an exemplary IL-12/IL-15RαSu DNA construct.

In a non-limiting example, an IL-12/IL-15RαSu DNA construct was created (FIG. 17). The human IL-12 subunit sequences, human IL-15RαSu sequence, human IL-15 sequence, human tissue factor 219 sequence, and human IL-18 sequence were obtained from the UniProt website and DNA for these sequences was synthesized by Genewiz. A DNA construct was made linking the IL-12 subunit beta (p40) to IL-12 subunit alpha (p35) with a GS (3) linker to generate a single chain version of IL-12 and then directly linking the IL-12 sequence to the IL-15RαSu sequence. The final IL-12/IL-15RαSu DNA construct sequence was synthesized by Genewiz.

The nucleic acid sequence of the IL12/IL-15RαSu construct (including signal peptide sequence) is as follows (SEQ ID NO: 181):

(Signal peptide)
ATGAAATGGGTGACCTTTATTTCTTTACTGTTCCTCTTTAGCAGCGCCT

ACTCC (Human IL-12 subunit beta (p40))
ATTTGGGAACTGAAGAAGGACGTCTACGTGGTCGAACTGGACTGGTAT

CCCGATGCTCCCGGCGAAATGGTGGTGCTCACTTGTGACACCCCCGAAGA

AGACGGCATCACTTGGACCCTCGATCAGAGCAGCGAGGTGCTGGGCTCCG

GAAAGACCCTCACAATCCAAGTTAAGGAGTTCGGAGACGCTGGCCAATAC

ACATGCCACAAGGGAGGCGAGGTGCTCAGCCATTCCTTATTATTATTACA

CAAGAAGGAAGACGGAATCTGGTCCACCGACATTTTAAAGATCAGAAGG

AGCCCAAGAATAAGACCTTTTTAAGGTGTGAGGCCAAAAACTACAGCGGT

CGTTTCACTTGTTGGTGGCTGACCACCATTTCCACCGATTTAACCTTCTC

CGTGAAAAGCAGCCGGGGAAGCTCCGACCCTCAAGGTGTGACATGTGGAG

CCGCTACCCTCAGCGCTGAGAGGGTTCGTGGCGATAACAAGGAATACGAG

TACAGCGTGGAGTGCCAAGAAGATAGCGCTTGTCCCGCTGCCGAAGAATC

TTTACCCATTGAGGTGATGGTGGACGCCGTGCACAAACTCAAGTACGAGA

ACTACACCTCCTCCTTCTTTATCCGGGACATCATTAAGCCCGATCCTCCT

AAGAATTTACAGCTGAAGCCTCTCAAAAATAGCCGGCAAGTTGAGGTCTC

TTGGGAATATCCCGACACTTGGAGCACACCCCACAGCTACTTCTCTTTAA

CCTTTTGTGTGCAAGTTCAAGGTAAAAGCAAGCGGGAGAAGAAAGACCGG

GTGTTTACCGACAAAACCAGCGCCACCGTCATCTGTCGGAAGAACGCCTC

CATCAGCGTGAGGGCTCAAGATCGTTATTACTCCAGCAGCTGGTCCGAGT

GGGCCAGCGTGCCTTGTTCC (Linker)
GGCGGTGGAGGATCCGGAGGAGGTGGCTCCGGCGGCGGAGGATCT (Human IL-12 subunit alpha (p35))
CGTAACCTCCCCGTGGCTACCCCCGATCCCGGAATGTTCCCTTGTTTAC

ACCACAGCCAGAATTTACTGAGGGCCGTGAGCAACATGCTGCAGAAAGCT

AGGCAGACTTTAGAATTTTACCCTTGCACCAGCGAGGAGATCGACCATGA

AGATATCACCAAGGACAAGACATCCACCGTGGAGGCTTGTTTACCTCTGG

AGCTGACAAAGAACGAGTCTTGTCTCAACTCTCGTGAAACCAGCTTCATC

ACAAATGGCTCTTGTTTAGCTTCCCGGAAGACCTCCTTTATGATGGCTTT

ATGCCTCAGCTCCATCTACGAGGATTTAAAGATGTACCAAGTGGAGTTCA

AGACCATGAACGCCAAGCTGCTCATGGACCCTAAACGGCAGATCTTTTTA

GACCAGAACATGCTGGCTGTGATTGATGAGCTGATGCAAGCTTTAAACTT

CAACTCCGAGACCGTCCCTCAGAAGTCCTCCCTCGAGGAGCCCGATTTTT

ACAAGACAAAGATCAAACTGTGCATTTTACTCCACGCCTTTAGGATCCGG

GCCGTGACCATTGACCGGGTCATGAGCTATTTAAACGCCAGC (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG

Example 6: Creation of an IL-18/TF/IL-15 DNA Construct

Figure 18:
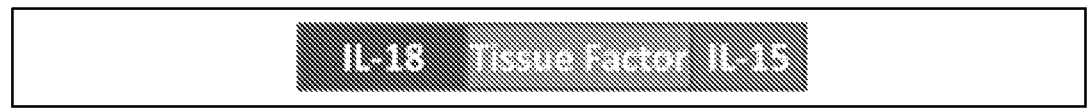
FIG. 18 shows a schematic diagram of an exemplary IL-18/TF/IL-15 DNA construct.

In a non-limiting example, an IL-18/TF/IL-15 construct was made (FIG. 18) linking the IL-18 sequence to the N-terminus coding region of tissue factor 219, and further linking the IL-18/TF construct with the N-terminus coding region of IL-15. The nucleic acid sequence of the IL-18/TF/IL-15 construct (including leader sequence), synthesized by Genewiz, is as follows (SEQ ID NO: 177):

(Signal peptide)
ATGAAGTGGGTCACATTTATCTCTTTACTGTTCCTCTTCTCCAGCGCCT

ACAGC (Human IL-18)
TACTTCGGCAAACTGGAATCCAAGCTGAGCGTGATCCGGAATTTAAAC

GACCAAGTTCTGTTTATCGATCAAGGTAACCGGCCTCTGTTCGAGGACAT

GACCGACTCCGATTGCCGGGACAATGCCCCCCGGACCATCTTCATTATCT

-continued
```
CCATGTACAAGGACAGCCAGCCCCGGGGCATGGCTGTGACAATTAGCGTG

AAGTGTGAGAAAATCAGCACTTTATCTTGTGAGAACAAGATCATCTCCTT

TAAGGAAATGAACCCCCCCGATAACATCAAGGACACCAAGTCCGATATCA

TCTTCTTCCAGCGGTCCGTGCCCGGTCACGATAACAAGATGCAGTTCGAA

TCCTCCTCCTACGAGGGCTACTTTTTAGCTTGTGAAAAGGAGAGGGATTT

ATTCAAGCTGATCCTCAAGAAGGAGGACGAGCTGGGCGATCGTTCCATCA

TGTTCACCGTCCAAAACGAGGAT
```

(Human Tissue Factor 219)
```
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG
```

(Human IL-15)
```
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC
```

Example 7: Secretion of IL-12/IL-15RαSu and IL-18/TF/IL-15 Fusion Proteins

Figure 19:
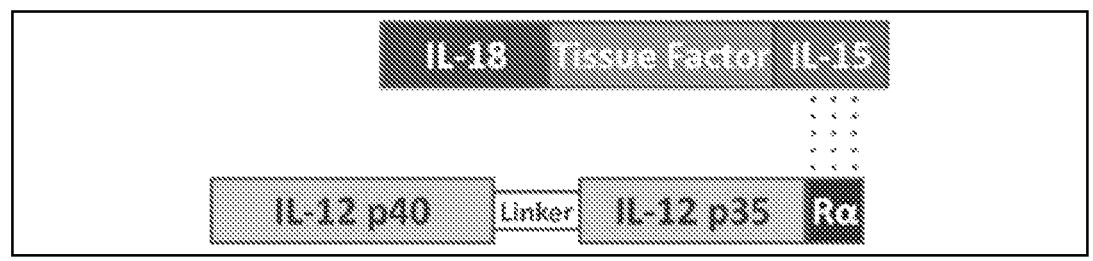
FIG. 19 shows a schematic diagram of the interaction between the exemplary IL-12/IL-15RαSu and IL-18/TF/IL-15 DNA constructs.
Figure 20:
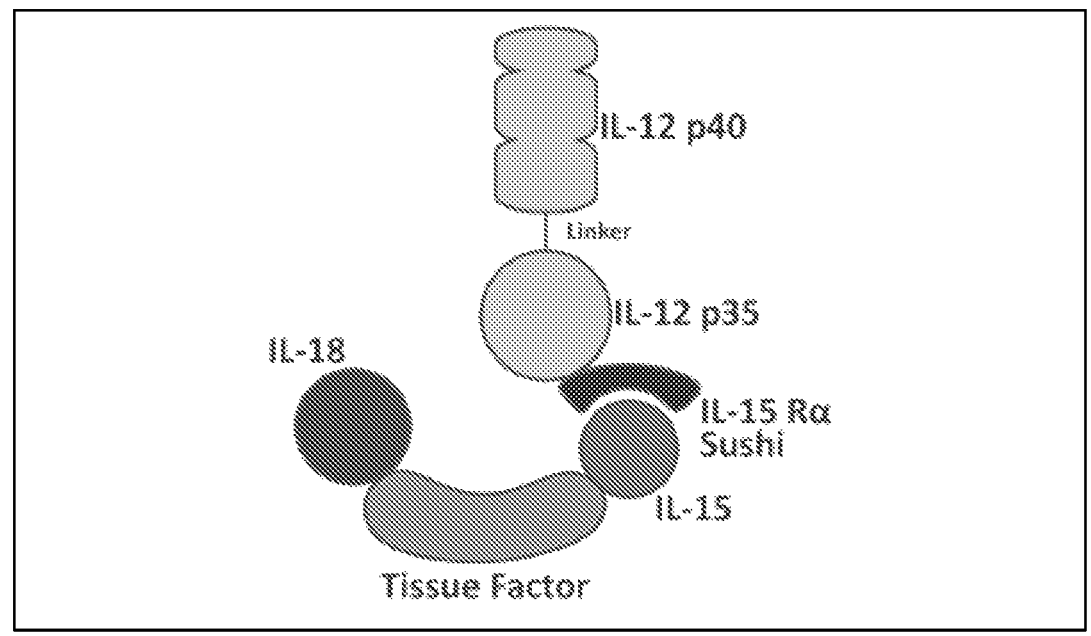
FIG. 20 shows a schematic diagram of the interaction between the exemplary IL-12/IL-15RαSu and IL-18/TF/IL-15 fusion proteins resulting in IL-18/TF/IL-15:IL-12/IL-15RαSu complex (18t15-12s).

The IL-12/IL-15RαSu and IL-18/TF/IL-15 DNA constructs were cloned into a pMSGV-1 modified retrovirus expression vector (as described by Hughes, *Hum Gene Ther* 16:457-72, 2005, hereby incorporated by reference), and the expression vector was transfected into CHO-K1 cells. Co-expression of the two constructs in CHO-K1 cells allowed for formation and secretion of a soluble IL-18/TF/IL-15:IL-12/IL-15RαSu protein complex (referred to as 18t15-12s; FIG. 19 and FIG. 20). The 18t15-12s protein was purified from CHO-K1 cell culture supernatant using anti-TF antibody affinity chromatography and size exclusion chromatography resulting in soluble (non-aggregated) protein complexes consisting of IL-12/IL-15RαSu and IL-18/TF/IL-15 fusion proteins.

The amino acid sequence of the IL12/IL-15RαSu fusion protein (including signal peptide sequence) is as follows (SEQ ID NO: 180):

(Signal peptide)
MKWVTFISLLFLFSSAYS (Human IL-12 subunit beta (p40))
IWELKKDVYVVELDWYPDAPGEMVVLTCDTPEEDGITWTLDQSSEVLGS

GKTLTIQVKEFGDAGQYTCHKGGEVLSHSLLLLHKKEDGIWSTDILKDQK

EPKNKTFLRCEAKNYSGRFTCWWLTTISTDLTFSVKSSRGSSDPQGVTCG

AATLSAERVRGDNKEYEYSVECQEDSACPAAEESLPIEVMVDAVHKLKYE

NYTSSFFIRDIIKPDPPKNLQLKPLKNSRQVEVSWEYPDTWSTPHSYFSL

TFCVQVQGKSKREKKDRVFTDKTSATVICRKNASISVRAQDRYYSSSWSE

WASVPCS (Linker)
GGGGSGGGGSGGGGS (Human IL-12 subunit alpha (p35))
RNLPVATPDPGMFPCLHHSQNLLRAVSNMLQKARQTLEFYPCTSEEIDHE

DITKDKTSTVEACLPLELTKNESCLNSRETSFITNGSCLASRKTSFMMAL

CLSSIYEDLKMYQVEFKTMNAKLLMDPKRQIFLDQNMLAVIDELMQALNF

NSETVPQKSSLEEPDFYKTKIKLCILLHAFRIRAVTIDRVMSYLNAS (Human IL-15R α sushi domain)
ITCPPPMSVEHADIWVKSYSLYSRERYICNSGFKRKAGTSSLTECVLNKA

TNVAHWTTPSLKCIR

The amino acid sequence of the IL-18/TF/IL-15 fusion protein (including signal peptide sequence) is as follows (SEQ ID NO: 176):

(Signal peptide)
MKWVTFISLLFLFSSAYS (Human IL-18)
YFGKLESKLSVIRNLNDQVLFIDQGNRPLFEDMTDSDCRDNAPRTIFIIS

MYKDSQPRGMAVTISVKCEKISTLSCENKIISFKEMNPPDNIKDTKSDII

FFQRSVPGHDNKMQFESSSYEGYFLACEKERDLFKLILKKEDELGDRSIM

FTVQNED (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

In some cases, the leader (signal sequence) peptide is cleaved from the intact polypeptide to generate the mature form that may be soluble or secreted.

Example 8: Purification of 18t15-12s by Immunoaffinity Chromatography

An anti-TF antibody affinity column was connected to a GE Healthcare™ AKTA Avant protein purification system. The flow rate was 4 mL/min for all steps except the elution step, which was 2 mL/min.

Figure 21:
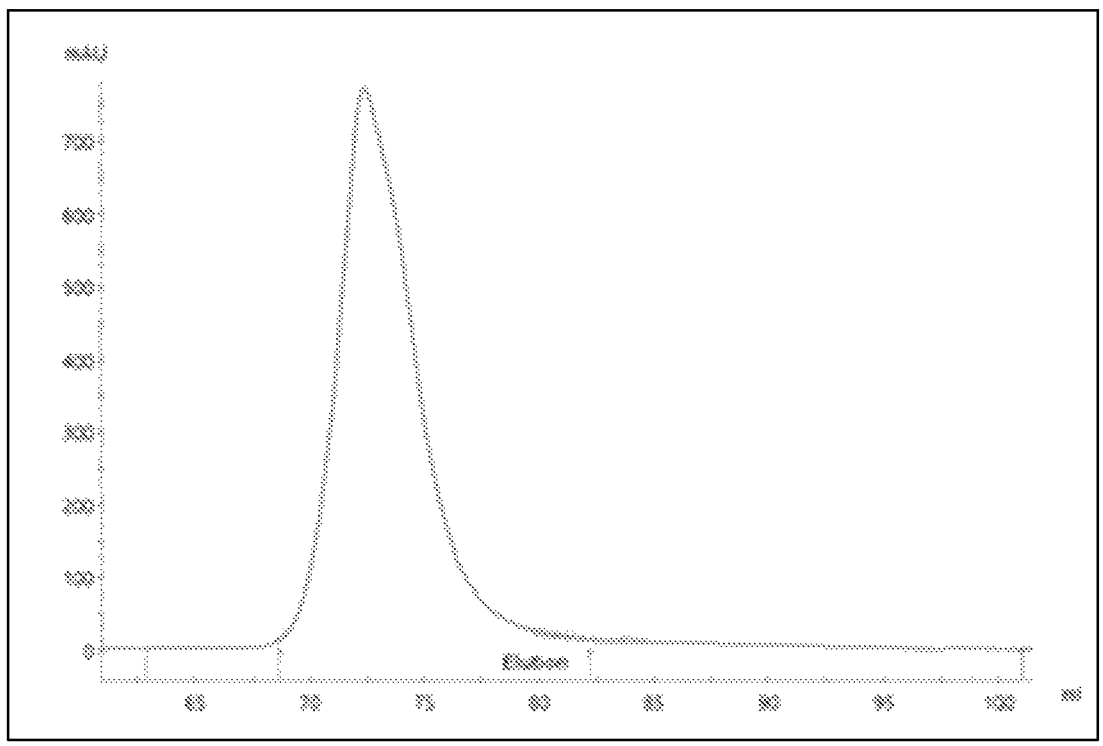
FIG. 21 shows a chromatograph of 18t15-12s purification elution from an anti-TF antibody affinity column.

Cell culture harvest of 18t15-12s was adjusted to pH 7.4 with 1M Tris base and loaded onto the anti-TF antibody affinity column equilibrated with 5 column volumes of PBS. After loading the sample, the column was washed with 5 column volumes PBS, followed by elution with 6 column volumes 0.1M acetic acid, pH 2.9. Absorbance at 280 nm was collected and then the sample was neutralized to pH 7.5-8.0 by adding 1M Tris base. The neutralized sample was then buffer exchanged into PBS using Amicon® centrifugal filters with a 30 KDa molecular weight cutoff. FIG. 21 shows that the 18t15-12s complex binds the anti-TF antibody affinity column, wherein TF is an 18t15-12s binding partner. The buffer-exchanged protein sample is stored at 2-8° C. for further biochemical analysis and biological activity testing.

After each elution, the anti-TF antibody affinity column was then stripped using 6 column volumes 0.1M glycine, pH 2.5. The column was then neutralized using 10 column volumes PBS, 0.05% sodium azide and stored at 2-8° C.

Example 9: Size Exclusion Chromatography of 18t15-12s

Figure 22:
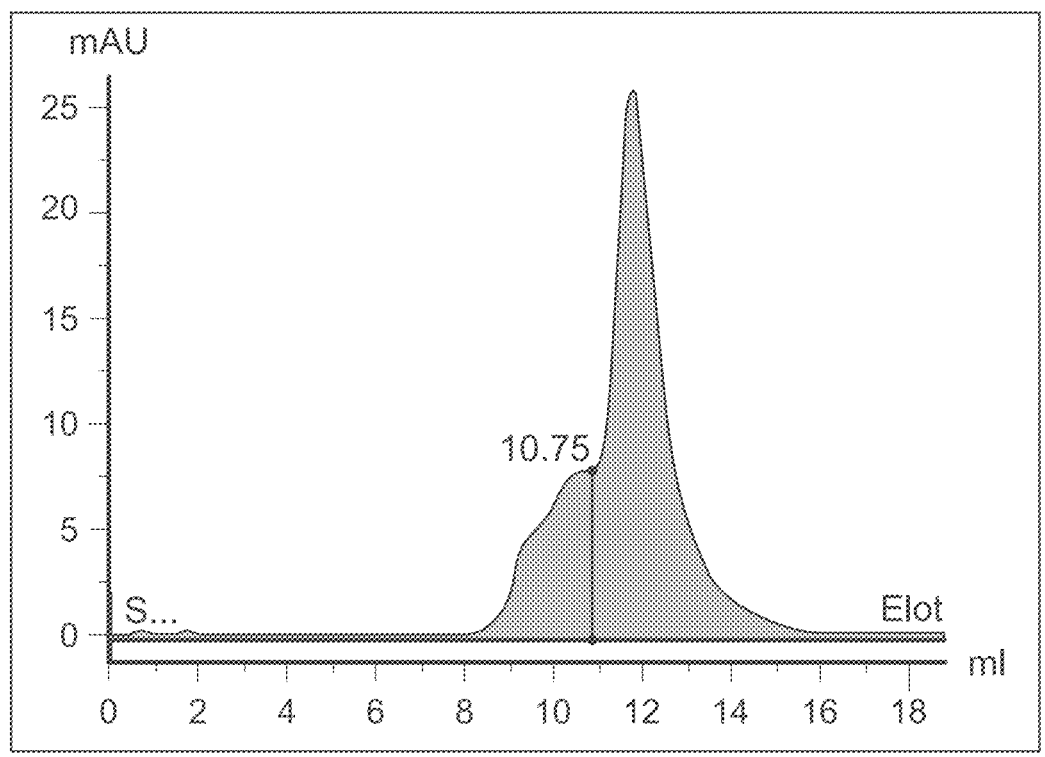
FIG. 22 shows an exemplary chromatographic profile of anti-TF Ab/SEC-purified 18t15-12s protein following elution on an analytical size exclusion column, demonstrating separation of monomeric multiprotein 18t15-12s complexes from protein aggregates.

A GE Healthcare Superdex® 200 Increase 10/300 GL gel filtration column was connected to a GE Healthcare AKTA™ Avant protein purification system. The column was equilibrated with 2 column volumes of PBS. The flow rate was 0.8 mL/min. A capillary loop was used to inject 200 µL of 1 mg/mL of 18t15-12s complex onto the column. The injection was chased with 1.25 column volumes of PBS. The SEC chromatograph is shown in FIG. 22. There is a main 18t15-12s protein peak with a minor high molecular weight peak, likely due to differing degrees of glycosylation of 18t15-12s dimers or aggregates.

Example 10: SDS-PAGE of 18t15-12s

Figure 23:
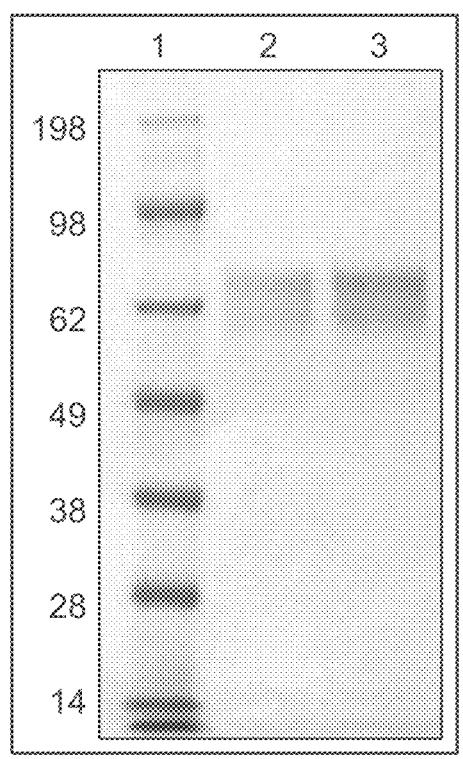
FIG. 23 shows an example of a 4-12% SDS-PAGE of the 18t15-12s complex following disulfide bond reduction. Lane 1: SeeBlue Plus2 marker; Lane 2: anti-TF Ab-purified 18t15-12s (0.5 µg); Lane 3: anti-TF Ab-purified 18t15-12s (1 µg).

To determine the purity and protein molecular weight, the purified 18t15-12s protein sample was analyzed using 4-12% NuPage Bis-Tris protein gel SDS-PAGE. The gel was stained with InstantBlue™ for about 30 min, followed by destaining overnight in purified water. FIG. 23 shows an example SDS gel of anti-TF antibody affinity purified 18t15-12s, with bands at the expected molecular weights (66 kDa and 56 kDa).

Example 11: Glycosylation of 18t15-12s in CHO-K1 Cells

Figure 24:
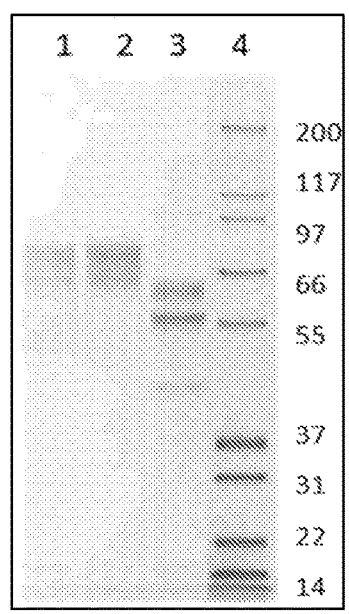
FIG. 24 shows SDS PAGE analysis of deglycosylated and non-deglycosylated 18t15-12s. Lane 1: anti-TF Ab-purified 18t15-12s (0.5 µg), non-deglycosylated; Lane 2: anti-TF Ab-purified 18t15-12s (1 µg), non-deglycosylated; Lane 3: 18t15-12s (1 µg), deglycosylated, Lane 4: Mark12 unstained maker.
Figure 25:
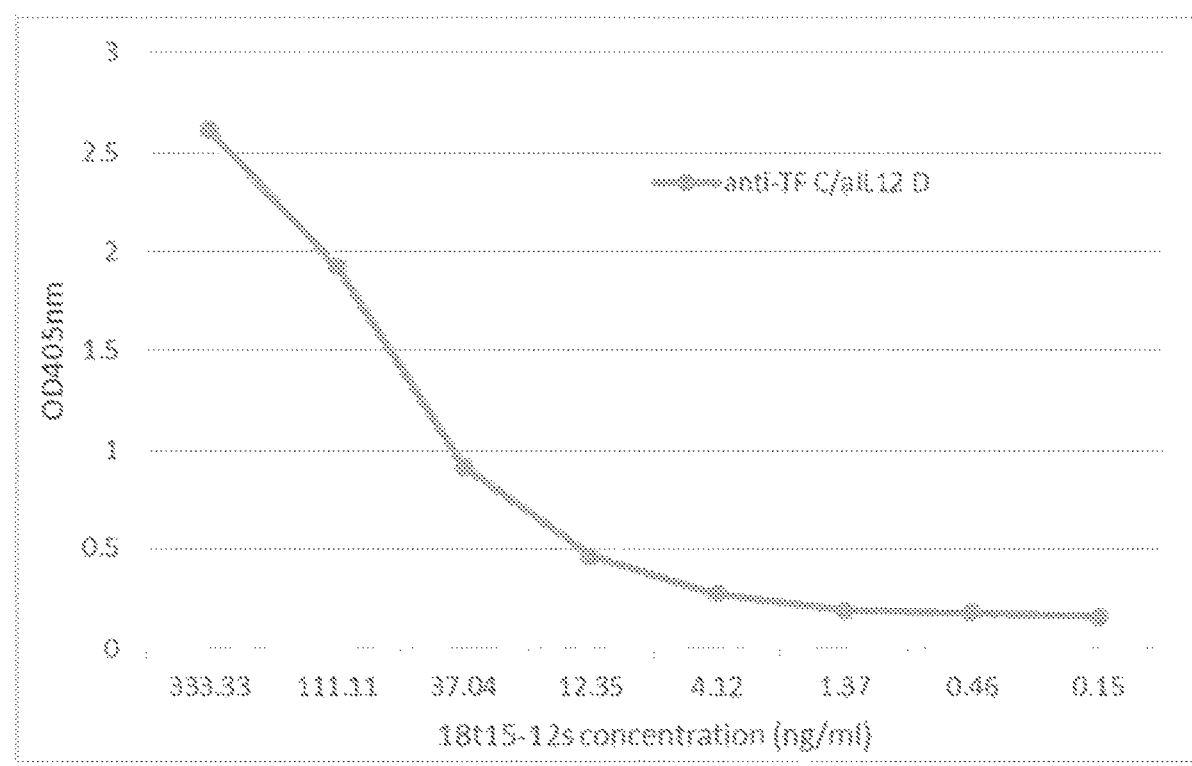
FIG. 25 shows a sandwich ELISA for the 18t15-12s complex, comprising an anti-human tissue factor antibody capture and a biotinylated anti-human IL-12 detection antibody (BAF 219).
Figure 26:
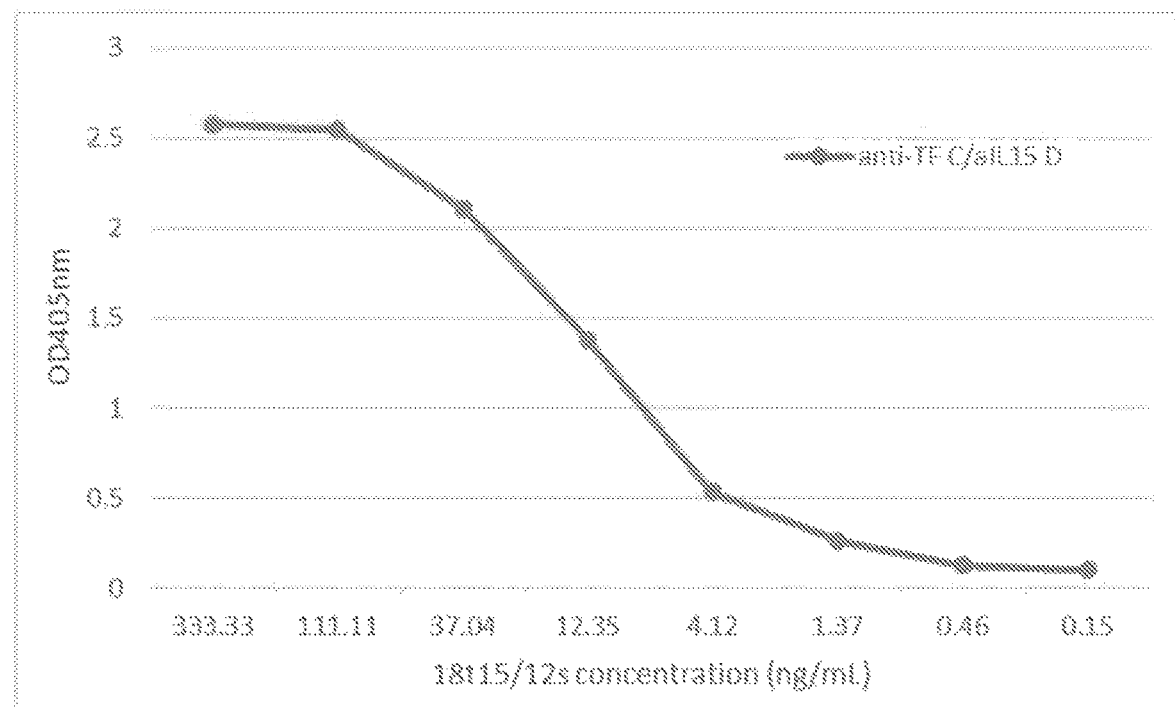
FIG. 26 shows a sandwich ELISA for the 18t15-12s complex, comprising an anti-human tissue factor antibody capture and a biotinylated anti-human IL-15 detection antibody (BAM 247).
Figure 27:
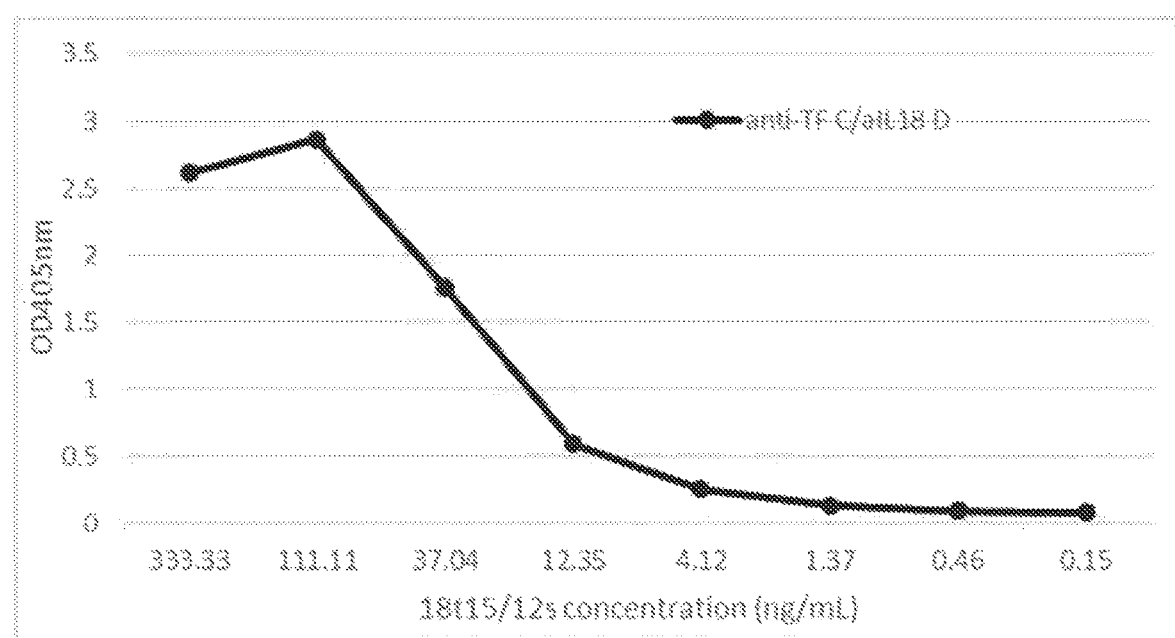
FIG. 27 shows a sandwich ELISA for the 18t15-12s complex, comprising an anti-human tissue factor antibody capture and a biotinylated anti-human IL-18 detection antibody (D045-6).
Figure 28:
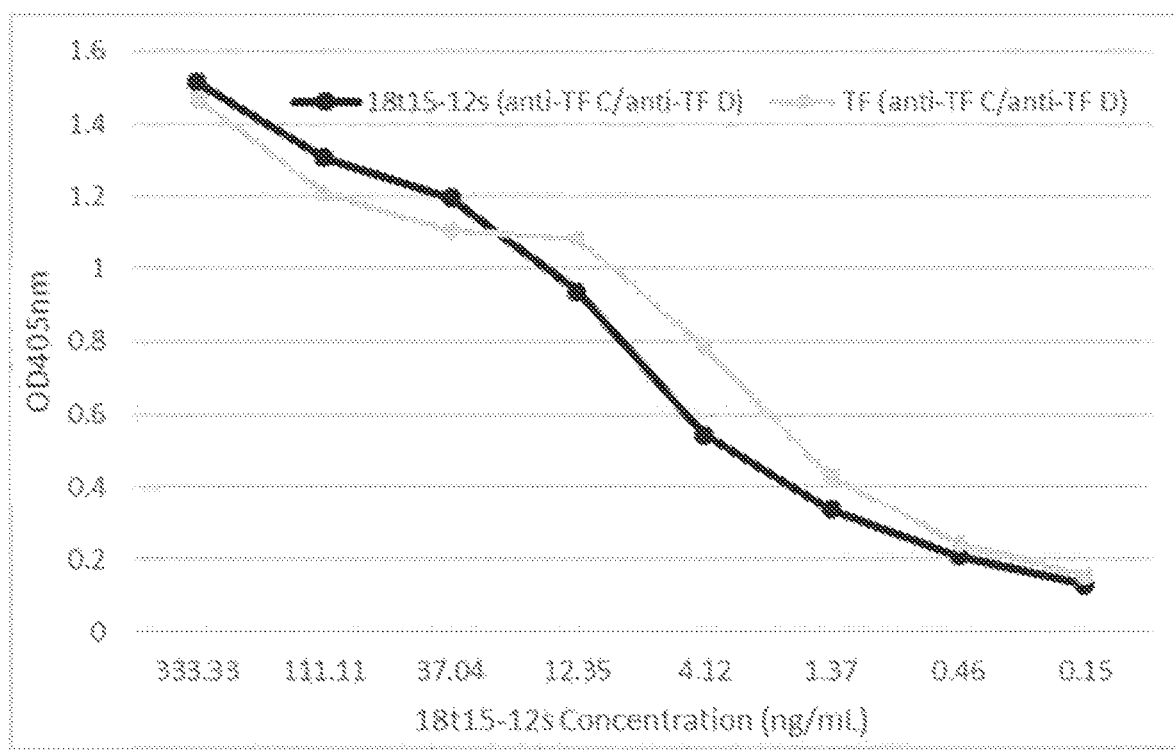
FIG. 28 shows a sandwich ELISA for the 18t15-12s complex, comprising an anti-human tissue factor (I43) capture antibody and an anti-human tissue factor detection antibody.
Figure 29:
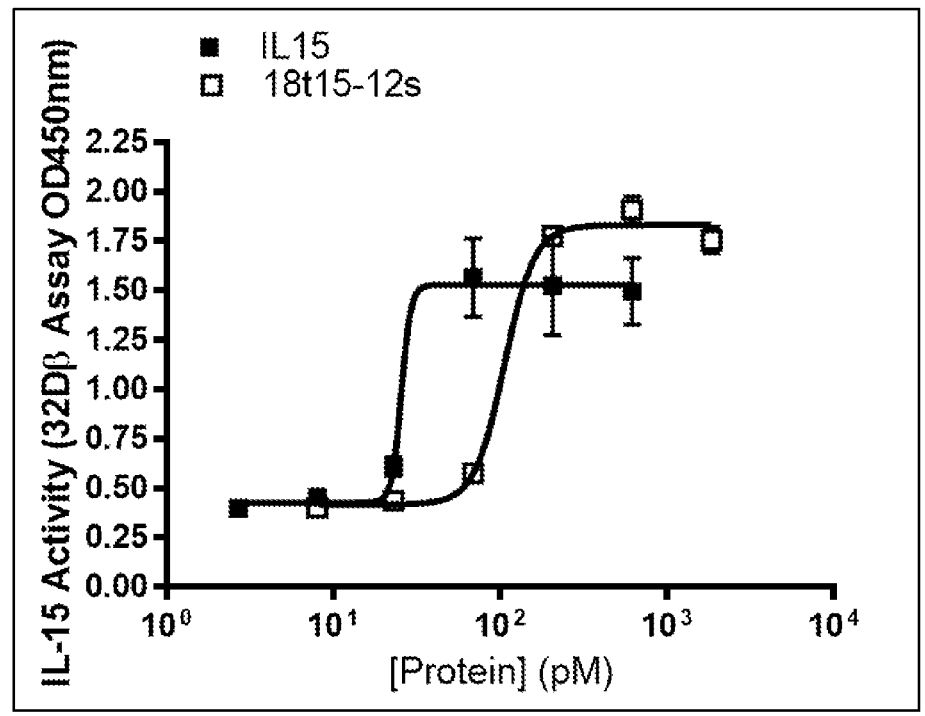
FIG. 29 shows proliferation of IL-15-dependent 3214 cells mediated by the 18t15-12s complex (open squares) and recombinant IL-15 (black squares).

Glycosylation of 18t15-12s in CHO-K1 cells was confirmed using the Protein Deglycosylation Mix II kit (New England Biolabs), according to the manufacturer's instructions. FIG. 24 shows an example SDS PAGE of deglycosylated and non-deglycosylated 18t15-12s. Deglycosylation reduces the molecular weight of 18t15-12s as seen in FIG. 24, lane 4.

Example 12: Recombinant Protein Quantitation of 18t15-12s Complexes

The 18t15-12s complex was detected and quantified using standard sandwich ELISA methods. (FIGS. 25-28). Anti-human tissue factor antibody served as the capture antibody and biotinylated anti-human IL-12, IL-15, or IL-18 antibody (BAF 219, BAM 247, D045-6, all R&D Systems) served as the detection antibody. Tissue factor in purified 18t15-12s protein complexes was also detected using an anti-human tissue factor capture antibody (143), and anti-human tissue factor antibody detection. The I43/anti-TF antibody ELISA was compared to purified tissue factor at similar concentrations.

Example 13: Immunostimulatory Capacity of the 18t15-12s Complex

To assess the IL-15 immunostimulatory activity of the 18t15-12s complex, increasing concentrations of 18t15-12s was added to 32Dβ cells (104 cell/well) in 200 µL IMDM: 10% FBS media. The 3214 cells were incubated for 3 days at 37° C. On the fourth day, WST-1 proliferation reagent (10 µL/well) was added and after 4 hours, absorbance was measured at 450 nm to determine cell proliferation based on cleavage of WST-1 to a soluble formazan dye. Bioactivity of human recombinant IL-15 was assessed as a positive control. As shown in FIG. 29, 18t15-12s demonstrated IL-15-dependent cell proliferation of 3214 cells. The 18t15-12s complex demonstrated reduced activity compared to human recombinant IL-15, possibly due to the linkage of IL-18 and tissue factor to the IL-15 domain.

Figure 30:
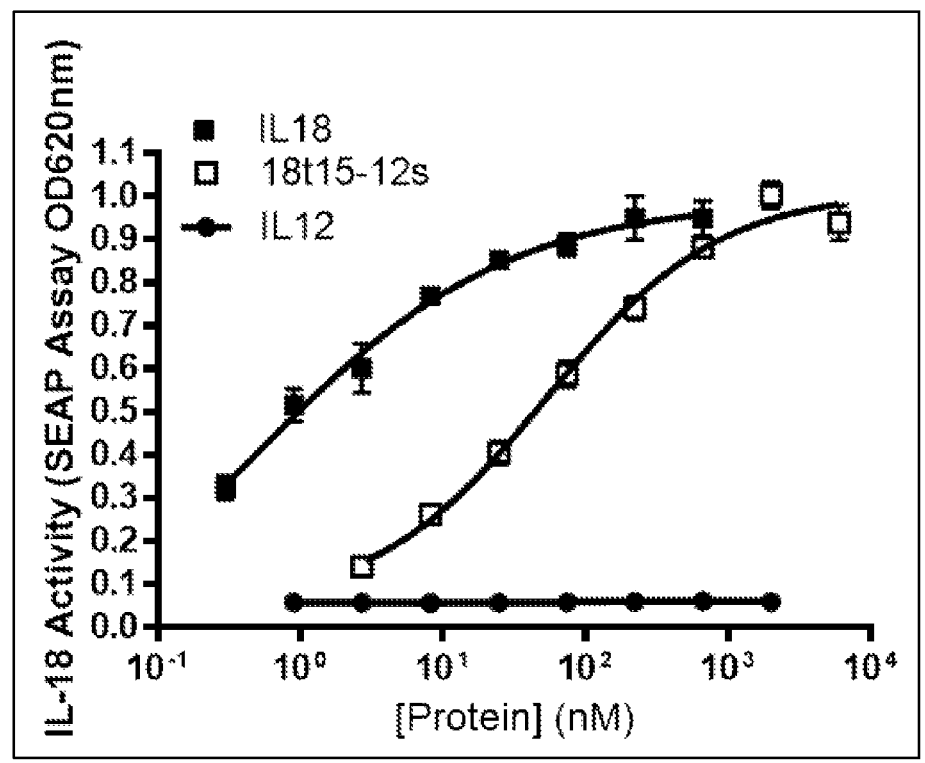
FIG. 30 shows biological activity of IL-18 within the 18t15-12s complex (open squares), where recombinant IL-18 (black squares) and recombinant IL-12 (black circles) serve as positive and negative controls, respectively.
Figure 31:
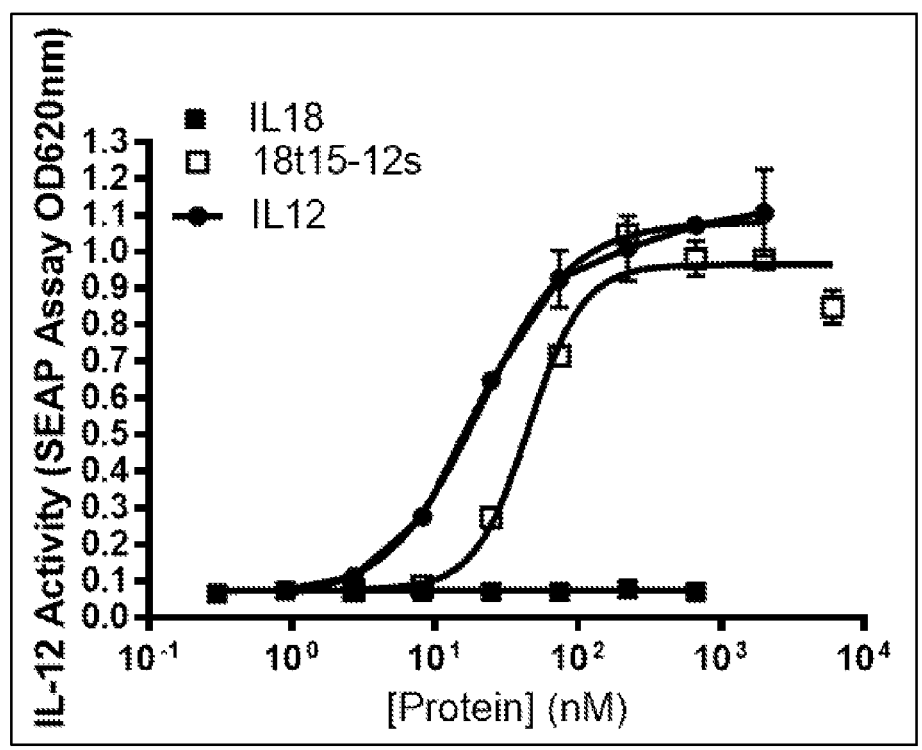
FIG. 31 shows biological activity of IL-12 within the 18t15-12s complex (open squares), where recombinant IL-12 (black circles) and recombinant IL-18 (open squares) serve as positive and negative controls, respectively.

In order to assess the individual activities of IL-12 and IL-18 in the 18t15-12s complex, 18t15-12s was added to HEK-Blue IL-12 and HEK-Blue IL-18 reporter cells ($5 \times 10^4$ cell/well; hkb-il12 and hkb-hmil18, InvivoGen) in 200 µL IMDM:10% heat-inactivated FBS media. Cells were incubated for overnight at 37° C. 20 µL of induced HEK-Blue IL-12 and HEK-Blue IL-18 reporter cell supernatant was added to 180 µl of QUANTI-Blue (InvivoGen), and incubated for 1-3 hours at 37° C. IL-12 or IL-18 activity was assessed by measuring absorbance at 620 nm. Human recombinant IL-12 or IL-18 was assessed as a positive or negative control. As shown in FIG. 30 and FIG. 31, each of the cytokine domains of the 18t15-12s complex retain specific biological activity. The activity of 18t15-12s was reduced compared to that of human recombinant IL-18 or IL-12, possibly due to linkage of IL-15 and tissue factor to the IL-18 domain and linkage of IL-12 to the IL-15Rα sushi domain.

Example 14: Induction of Cytokine-Induced Memory-Like NK Cells by the 18t15-12s Complex Cytokine-induced memory-like NK cells can be induced ex vivo following overnight stimulation of purified NK cells with saturating amounts of IL-12 (10 ng/mL), IL-15 (50 ng/mL), and IL-18 (50 ng/mL). These memory-like properties have been measured through expression of IL-2 receptor a (IL-2Rα, CD25), CD69 (and other activation markers), and increased IFN-γ production. To evaluate the ability of 18t15-12s complexes to promote generation of cytokine-induced memory-like NK cells, purified human NK cells (>95% CD56+) were stimulated for 14-18 hours with 0.01 nM to 10000 nM of the 18t15-12s complex or a combination of individual cytokines (recombinant IL-12 (10 ng/ml), IL-18 (50 ng/ml), and IL-15 (50 ng/ml)). Cell-surface CD25 and CD 69 expression and intracellular IFN-γ levels were assessed by antibody-staining and flow cytometry.

Figure 32A:
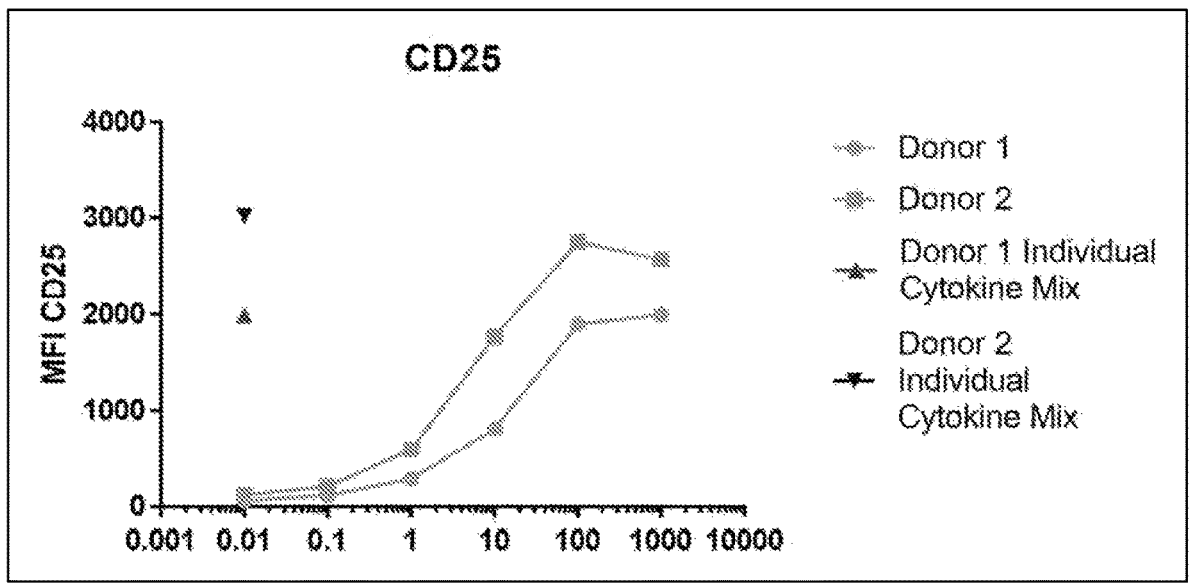
FIGS. 32A and 32B show cell-surface expression of CD25 on NK cells induced by the 18t15-12s complex and cell-surface CD69 expression of NK cells induced by the 18t15-12s complex.
Figure 32B:
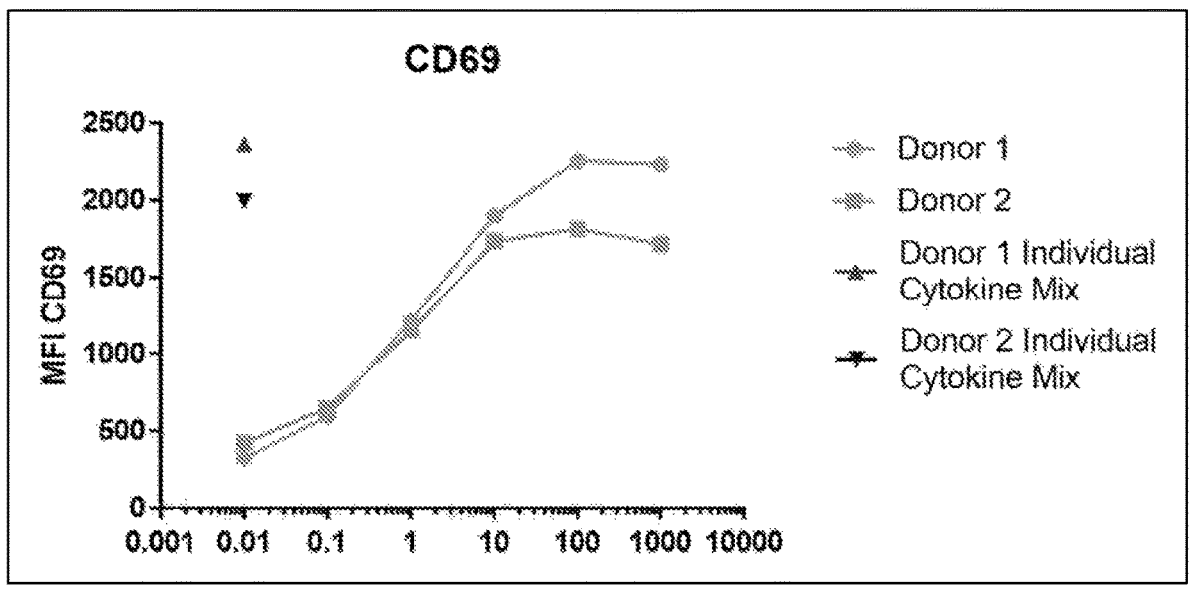

Fresh human leukocytes were obtained from a blood bank and CD56+ NK cells were isolated with the RosetteSep/human NK cell reagent (StemCell Technologies). The purity of NK cells was >70% and confirmed by staining with CD56-BV421, CD16-BV510, CD25-PE, CD69-APC-Fire750 specific antibodies (BioLegend). Cells were counted and resuspended in 0.2×10⁶/mL in a 96 well flat bottom plate in 0.2 mL of complete media (RPMI 1640 (Gibco), supplemented with 2 mM L-glutamine (Thermo Life Technologies), penicillin (Thermo Life Technologies), streptomycin (Thermo Life Technologies), and 10% FBS (Hyclone)). Cells were stimulated with either a mixture of cytokines hIL-12 (10 ng/mL) (Biolegend), hIL-18 (50 ng/mL) (R&D Systems) and hIL-15 (50 ng/mL) (NCI) or with 0.01 nM to 10000 nM of the 18t15-12s at 37° C., 5% $CO_2$ for 14-18 hrs. The cells were then harvested and surface stained for CD56-BV421, CD16-BV510, CD25-PE, CD69-APCFire750 specific antibodies (BioLegend) for 30 minutes. After staining, cells were washed (1500 RPM for 5 minutes at room temperature) in FACS buffer (IX PBS (Hyclone), with 0.5% BSA (EMD Millipore) and 0.001% sodium azide (Sigma)). After two washes, cells were analyzed using a BD FACS-Celesta™ flow cytometer (Plotted Data-Mean Fluorescence Intensity; Figure. 32A and FIG. 32B).

Figure 33:
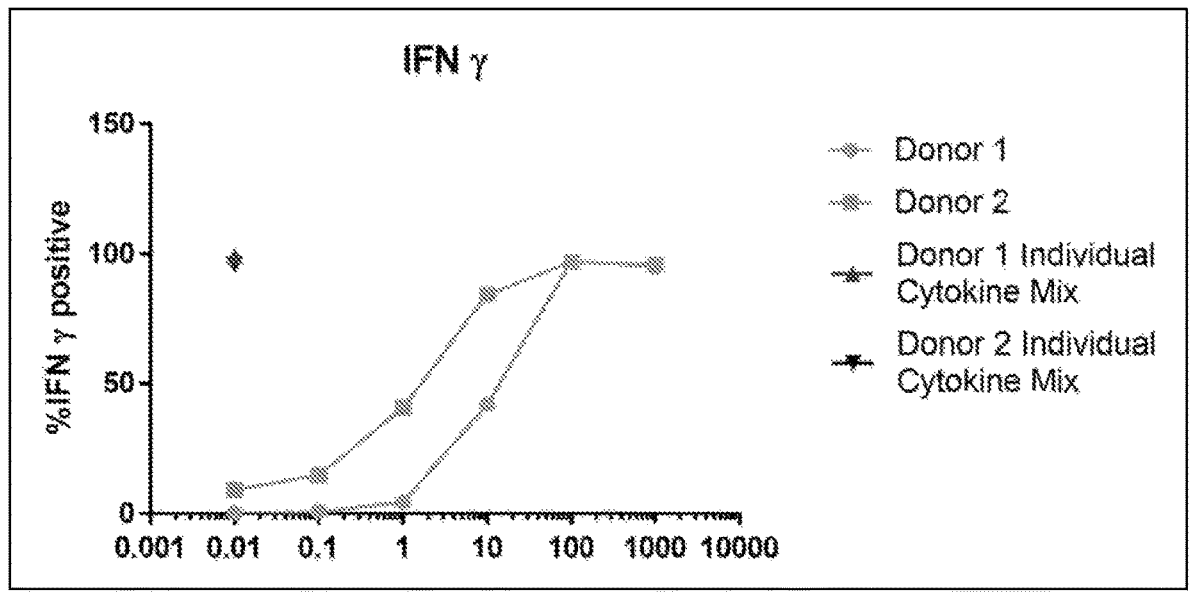
FIG. 33 shows a flow cytometry graph of intracellular IFN-γ expression of NK cells induced by the 18t15-12s complex.

Fresh human leukocytes were obtained from a blood bank and CD56+NK cells were isolated with the RosetteSep/human NK cell reagent (StemCell Technologies). The purity of NK cells was >70% and confirmed by staining with CD56-BV421, CD16-BV510, CD25-PE, CD69-APC-Fire750 specific antibodies (BioLegend). Cells were counted and resuspended in 0.2×10⁶/mL in a 96 well flat bottom plate in 0.2 mL of complete media (RPMI 1640 (Gibco), supplemented with 2 mM L-glutamine (Thermo Life Technologies), penicillin (Thermo Life Technologies), streptomycin (Thermo Life Technologies), and 10% FBS (Hyclone)). Cells were stimulated with either a cytokine mix of hIL-12 (10 ng/mL) (Biolegend), hIL-18 (50 ng/mL) (R&D), and hIL-15 (50 ng/mL) (NCI), or 0.01 nM to 10000 nM of the 18t15-12s complex at 37° C., 5% $CO_2$ for 14-18 hrs. The cells were then treated with 10 μg/mL of Brefeldin A (Sigma) and 1× of Monensin (eBioscience) for 4 hrs before harvesting and staining for CD56-BV421, CD16-BV510, CD25-PE, CD69-APCFire750 specific antibodies for 30 minutes. After staining, cells were washed (1500 RPM for 5 minutes in room temperature) in FACS buffer (1×PBS (Hyclone), with 0.5% BSA (EMD Millipore) and 0.001% sodium azide (Sigma)) and fixed for 10 minutes at room temperature. After fixation, cells were washed (1500 RPM for 5 minutes in room temperature) in 1× permeabilized buffer (eBioscience) and stained with IFN-γ-PE (Biolegend) for 30 minutes at room temperature. Cells were washed once again with 1× permeabilized buffer and then washed with FACS buffer. Cell pellets were resuspended in 300 ills of FACS buffer and analyzed using a BD FACSCelesta™ flow cytometer (Plotted % of IFN-γ Positive Cells; FIG. 33).

Example 15: In Vitro Cytotoxicity of NK Cells Against Human Tumor Cells

Figure 34:
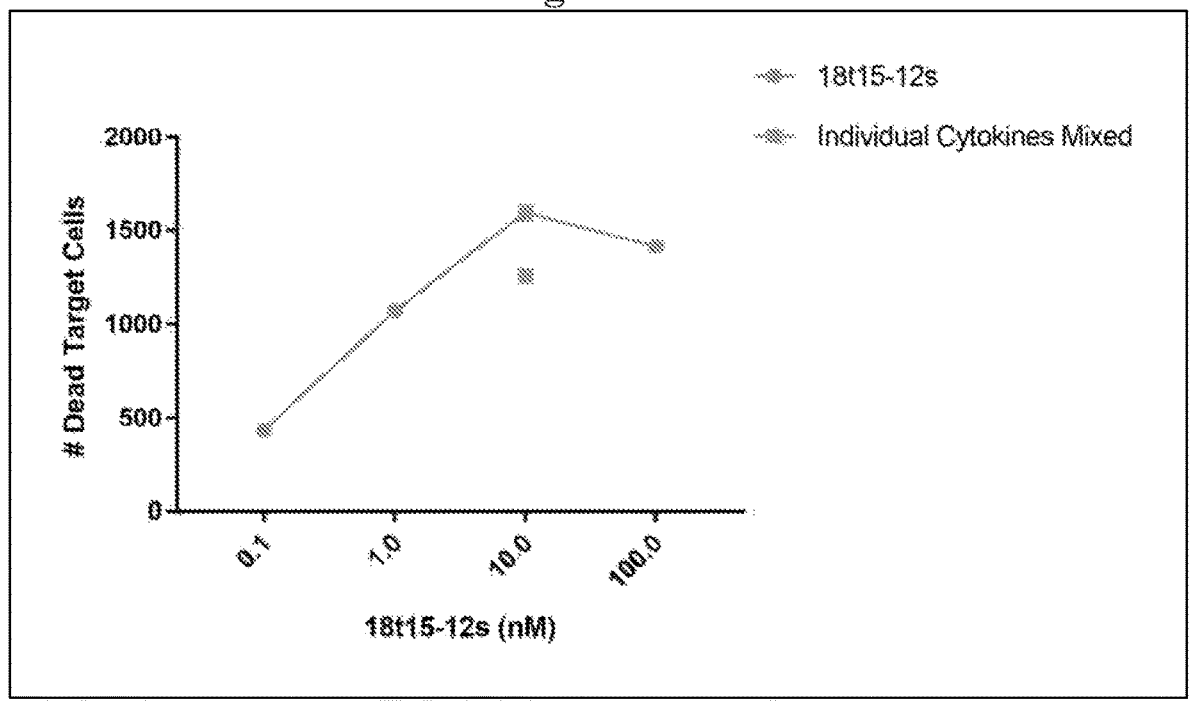
FIG. 34 shows cytotoxicity of 18t15-12s induced human NK cells against K562 cells.

Human myelogenous leukemia cells, K562 (CellTrace Violet labelled), were incubated with purified human NK cells in the presence of increasing concentrations of the 18t15-12s complex or a mixture of cytokines as a control. After 20 hours, the cultures were harvested, stained with propidium iodide (PI), and assessed by flow cytometry. As shown in FIG. 34, the 18t15-12s complex induced human NK cytotoxicity against K562, at levels similar or greater than the cytokine mixture, wherein both the 18t15-12s complex and the cytokine mixture induced greater cytotoxicity than the medium control.

Figure 35:
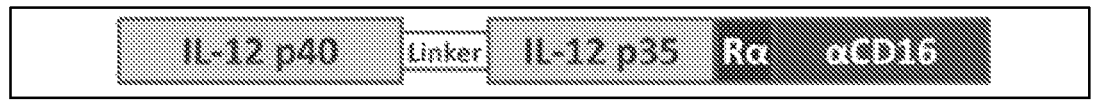
FIG. 35 shows a schematic diagram of an exemplary IL-12/IL-15RαSu/αCD16 DNA construct.
Figure 36:
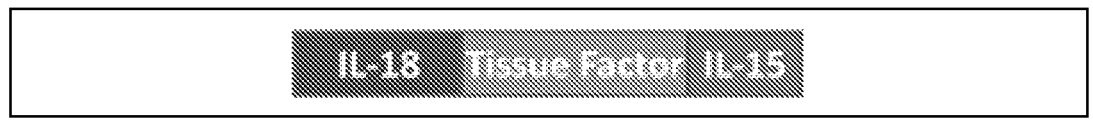
FIG. 36 shows a schematic diagram of an exemplary IL-18/TF/IL-15 DNA construct.

Example 16: Creation of IL-12/IL-15RαSu/αCD16scFv and IL-18/TF/IL-15 DNA Constructs In a non-limiting example, IL-12/IL-15RαSu/αCD16scFv and IL-18/TF/IL-15 DNA constructs were created (FIG. 35 and FIG. 36). The human IL-12 subunit sequences, human IL-15RαSu sequence, human IL-15 sequence, human tissue factor 219 sequence, and human IL-18 sequence were synthesized by Genewiz. A DNA construct was made linking the IL-12 subunit beta (p40) to IL-12 subunit alpha (p35) with a GS (3) linker to generate a single chain version of IL-12, directly linking the IL-12 sequence to the IL-15RαSu sequence, and directly linking the IL-12/IL-15RαSu construct to the N-terminus coding region of αCD16scFv.

The nucleic acid sequence of the IL-12/IL-15RαSu/αCD16scFv construct is as follows (SEQ ID NO: 226):

```
(Signal peptide)
ATGAAATGGGTGACCTTTATTTCTTTACTGTTCCTCTTTAGCAGCGCCTA

CTCC (Human IL-12 subunit beta (p40))
ATTTGGGAACTGAAGAAGGACGTCTACGTGGTCGAACTGGACTGGTAT

CCCGATGCTCCCGGCGAAATGGTGGTGCTCACTTGTGACACCCCCGAAGA

AGACGGCATCACTTGGACCCTCGATCAGAGCAGCGAGGTGCTGGGCTCCG

GAAAGACCCTCACAATCCAAGTTAAGGAGTTCGGAGACGCTGGCCAATAC

ACATGCCACAAGGGAGGCGAGGTGCTCAGCCATTCCTTATTATTATTACA

CAAGAAGGAAGACGGAATCTGGTCCACCGACATTTTAAAAGATCAGAAGG

AGCCCAAGAATAAGACCTTTTTAAGGTGTGAGGCCAAAAACTACAGCGGT

CGTTTCACTTGTTGGTGGCTGACCACCATTTCCACCGATTTAACCTTCTC

CGTGAAAAGCAGCCGGGGAAGCTCCGACCCTCAAGGTGTGACATGTGGAG

CCGCTACCCTCAGCGCTGAGAGGGTTCGTGGCGATAACAAGGAATACGAG

TACAGCGTGGAGTGCCAAGAAGATAGCGCTTGTCCCGCTGCCGAAGAATC

TTTACCCATTGAGGTGATGGTGGACGCCGTGCACAAACTCAAGTACGAGA

ACTACACCTCCTCCTTCTTTATCCGGGACATCATTAAGCCCGATCCTCCT

AAGAATTTACAGCTGAAGCCTCTCAAAAATAGCCGGCAAGTTGAGGTCTC

TTGGGAATATCCCGACACTTGGAGCACACCCCACAGCTACTTCTCTTTAA

CCTTTTGTGTGCAAGTTCAAGGTAAAAGCAAGCGGGAGAAGAAAGACCGG

GTGTTTACCGACAAAACCAGCGCCACCGTCATCTGTCGGAAGAACGCCTC

CATCAGCGTGAGGGCTCAAGATCGTTATTACTCCAGCAGCTGGTCCGAGT

GGGCCAGCGTGCCTTGTTCC (Linker)
GGCGGTGGAGGATCCGGAGGAGGTGGCTCCGGCGGCGGAGGATCT (Human IL-12 subunit alpha (p35))
CGTAACCTCCCCGTGGCTACCCCCGATCCCGGAATGTTCCCTTGTTTAC

ACCACAGCCAGAATTTACTGAGGGCCGTGAGCAACATGCTGCAGAAAGCT

AGGCAGACTTTAGAATTTTACCCTTGCACCAGCGAGGAGATCGACCATGA

AGATATCACCAAGGACAAGACATCCACCGTGGAGGCTTGTTTACCTCTGG

AGCTGACAAAGAACGAGTCTTGTCTCAACTCTCGTGAAACCAGCTTCATC
```

-continued
```
ACAAATGGCTCTTGTTTAGCTTCCCGGAAGACCTCCTTTATGATGGCTTT

ATGCCTCAGCTCCATCTACGAGGATTTAAAGATGTACCAAGTGGAGTTCA

AGACCATGAACGCCAAGCTGCTCATGGACCCTAAACGGCAGATCTTTTTA

GACCAGAACATGCTGGCTGTGATTGATGAGCTGATGCAAGCTTTAAACTT

CAACTCCGAGACCGTCCCTCAGAAGTCCTCCCTCGAGGAGCCCGATTTTT

ACAAGACAAAGATCAAACTGTGCATTTTACTCCACGCCTTTAGGATCCGG

GCCGTGACCATTGACCGGGTCATGAGCTATTTAAACGCCAGC (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG (anti-Human CD16 light chain variable domain)
TCCGAGCTGACCCAGGACCCTGCTGTGTCCGTGGCTCTGGGCCAGACC

GTGAGGATCACCTGCCAGGGCGACTCCCTGAGGTCCTACTACGCCTCCTG

GTACCAGCAGAAGCCCGGCCAGGCTCCTGTGCTGGTGATCTACGGCAAGA

ACAACAGGCCCTCCGGCATCCCTGACAGGTTCTCCGGATCCTCCTCCGGC

AACACCGCCTCCCTGACCATCACAGGCGCTCAGGCCGAGGACGAGGCTGA

CTACTACTGCAACTCCAGGGACTCCTCCGGCAACCATGTGGTGTTCGGCG

GCGGCACCAAGCTGACCGTGGGCCAT (Linker)
GGCGGCGGCGGCTCCGGAGGCGGCGGCAGCGGCGGAGGAGGATCC (anti-Human CD16 heavy chain variable domain)
GAGGTGCAGCTGGTGGAGTCCGGAGGAGGAGTGGTGAGGCCTGGAGG

CTCCCTGAGGCTGAGCTGTGCTGCCTCCGGCTTCACCTTCGACGACTACG

GCATGTCCTGGGTGAGGCAGGCTCCTGGAAAGGGCCTGGAGTGGGTGTCC

GGCATCAACTGGAACGGCGGATCCACCGGCTACGCCGATTCCGTGAAGGG

CAGGTTCACCATCAGCAGGGACAACGCCAAGAACTCCCTGTACCTGCAGA

TGAACTCCCTGAGGGCCGAGGACACCGCCGTGTACTACTGCGCCAGGGGC

AGGTCCCTGCTGTTCGACTACTGGGGACAGGGCACCCTGGTGACCGTGTC

CAGG
```

Constructs were also made linking the IL-18 sequence to the N-terminus coding region of tissue factor 219, and linking the IL-18/TF construct with the N-terminus coding region of IL-15 (FIG. 36). The nucleic acid sequence of the IL-18/TF/IL-15 construct (including leader sequence) is as follows (SEQ ID NO: 177):

```
(Signal peptide)
ATGAAGTGGGTCACATTTATCTCTTTACTGTTCCTCTTCTCCAGCGCCT

ACAGC (Human IL-18)
TACTTCGGCAAACTGGAATCCAAGCTGAGCGTGATCCGGAATTTAAAC

GACCAAGTTCTGTTTATCGATCAAGGTAACCGGCCTCTGTTCGAGGACAT

GACCGACTCCGATTGCCGGGACAATGCCCCCCGGACCATCTTCATTATCT

CCATGTACAAGGACAGCCAGCCCCGGGGCATGGCTGTGACAATTAGCGTG

AAGTGTGAGAAAATCAGCACTTTATCTTGTGAGAACAAGATCATCTCCTT

TAAGGAAATGAACCCCCCCGATAACATCAAGGACACCAAGTCCGATATCA

TCTTCTTCCAGCGGTCCGTGCCCGGTCACGATAACAAGATGCAGTTCGAA

TCCTCCTCCTACGAGGGCTACTTTTTAGCTTGTGAAAAGGAGAGGGATTT

ATTCAAGCTGATCCTCAAGAAGGAGGACGAGCTGGGCGATCGTTCCATCA

TGTTCACCGTCCAAAACGAGGAT (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC
```

Figure 37:
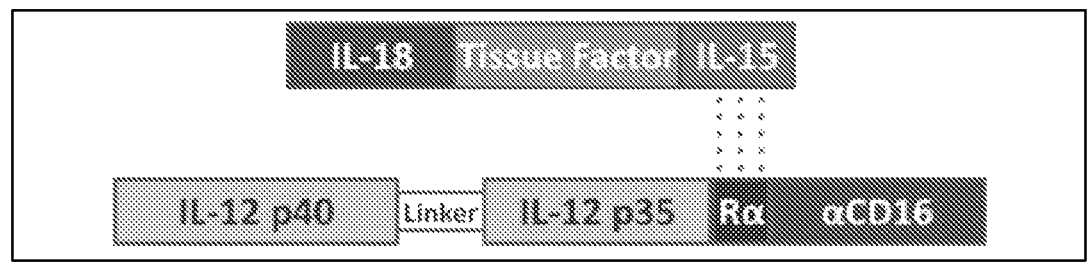
FIG. 37 shows a schematic diagram of the interaction between the exemplary IL-12/IL-15RαSu/αCD16scFv and IL-18/TF/IL-15 DNA constructs.
Figure 38:
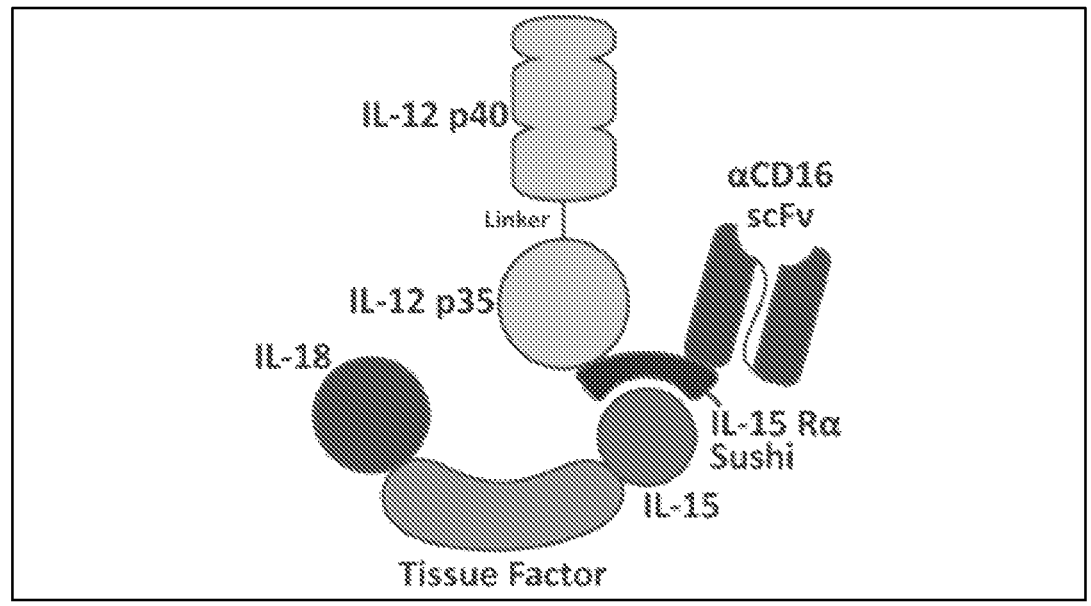
FIG. 38 shows a schematic diagram of an exemplary 18t15-12s/αCD16 protein complex.

Example 17: Secretion of IL-12/IL-15RαSu/αCD16scFv and IL-18/TF/IL-15 Fusion Proteins The IL-12/IL-15RαSu/αCD16scFv and IL-18/TF/IL-15 constructs were cloned into a pMSGV-1 modified retrovirus expression vector (Hughes, *Hum Gene Ther* 16:457-72, 2005, herein incorporated by reference), and the expression vector was transfected into CHO-K1 cells. Co-expression of the two constructs in CHO-K1 cells resulted in secretion of a soluble IL-18/TF/IL-15:IL-12/IL-15RαSu/αCD16scFv protein complex (referred to as 18t15-12s/αCD16; FIG. 37 and FIG. 38). Co-expression of the two constructs in CHO-K1 cells resulted in secretion of the soluble IL-18/TF/IL-15:IL-12/IL-15RαSu/αCD16scFv protein complex (referred to as 18t15-12s/αCD16; FIG. 37 and FIG. 38), which can be purified by anti-TF Ab affinity and other chromatography methods. In some cases, the signal peptide is cleaved from the intact polypeptide to generate the mature form.

The amino acid sequence of the IL-12/IL-15RαSu/αCD16scFv fusion protein (including signal peptide sequence) is as follows (SEQ ID NO: 225):

(Signal peptide)
MKWVTFISLLFLFSSAYS (Human IL-12 subunit beta (p40))
IWELKKDVYVVELDWYPDAPGEMVVLTCDTPEEDGITWTLDQSSEVLGS

GKTLTIQVKEFGDAGQYTCHKGGEVLSHSLLLLHKKEDGIWSTDILKDQK

EPKNKTFLRCEAKNYSGRFTCWWLTTISTDLTFSVKSSRGSSDPQGVTCG

AATLSAERVRGDNKEYEYSVECQEDSACPAAEESLPIEVMVDAVHKLKYE

NYTSSFFIRDIIKPDPPKNLQLKPLKNSRQVEVSWEYPDTWSTPHSYFSL

TFCVQVQGKSKREKKDRVFTDKTSATVICRKNASISVRAQDRYYSSSWSE

WASVPCS (Linker)
GGGGSGGGGSGGGGS (Human IL-12 subunit alpha (p35))
RNLPVATPDPGMFPCLHHSQNLLRAVSNMLQKARQTLEFYPCTSEEIDHE

DITKDKTSTVEACLPLELTKNESCLNSRETSFITNGSCLASRKTSFMMAL

CLSSIYEDLKMYQVEFKTMNAKLLMDPKRQIFLDQNMLAVIDELMQALNF

NSETVPQKSSLEEPDFYKTKIKLCILLHAFRIRAVTIDRVMSYLNAS (Human IL-15R α sushi domain)
ITCPPPMSVEHADIWVKSYSLYSRERYICNSGFKRKAGTSSLTECVLNKA

TNVAHWTTPSLKCIR (anti-Human CD16 light chain variable domain)
SELTQDPAVSVALGQTVRITCQGDSLRSYYASWYQQKPGQAPVLVIYGK

NNRPSGIPDRFSGSSSGNTASLTITGAQAEDEADYYCNSRDSSGNHVVFG

GGTKLTVGH (Linker)
GGGGSGGGGSGGGGS (anti-Human CD16 heavy chain variable domain)
EVQLVESGGGVVRPGGSLRLSCAASGFTFDDYGMSWVRQAPGKGLEWV

SGINWNGGSTGYADSVKGRFTISRDNAKNSLYLQMNSLRAEDTAVYYCAR

GRSLLFDYWGQGTLVTVSR

The amino acid sequence of the IL-18/TF/IL-15 fusion protein (including leader sequence) is as follows (SEQ ID NO: 221):

(Signal peptide)
MKWVTFISLLFLFSSAYS (Human IL-18)
YFGKLESKLSVIRNLNDQVLFIDQGNRPLFEDMTDSDCRDNAPRTIFIIS

MYKDSQPRGMAVTISVKCEKISTLSCENKIISFKEMNPPDNIKDTKSDII

FFQRSVPGHDNKMQFESSSYEGYFLACEKERDLFKLILKKEDELGDRSIM

FTVQNED (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

Example 18: Creation of IL-18/IL-15RαSu and IL-12/TF/IL-15 DNA Constructs

In a non-limiting example, IL-18/IL-15RαSu and IL-12/TF/IL-15 DNA constructs were created. The human IL-18 subunit sequences, human IL-15RαSu sequence, human IL-12 sequence, human tissue factor 219 sequence, and human IL-15 sequence were synthesized by Genewiz. A DNA construct was made linking IL-18 directly to IL-15RαSu. An additional construct was also made linking IL-12 sequence to the N-terminus coding region of human tissue factor 219 form, and further linking the IL-12/TF construct to the N-terminus coding region of IL-15. As described above, a single-chain version of IL-12 (p40-linker-p35) was used.

The nucleic acid sequence of the IL-18/IL-15RαSu construct (including signal peptide sequence) is as follows (SEQ ID NO: 320):

(Signal peptide)
ATGAAGTGGGTCACATTTATCTCTTTACTGTTCCTCTTCTCCAGCGCCT

ACAGC (Human IL-18)
TACTTCGGCAAACTGGAATCCAAGCTGAGCGTGATCCGGAATTTAAAC

GACCAAGTTCTGTTTATCGATCAAGGTAACCGGCCTCTGTTCGAGGACAT

GACCGACTCCGATTGCCGGGACAATGCCCCCCGGACCATCTTCATTATCT

CCATGTACAAGGACAGCCAGCCCCGGGGCATGGCTGTGACAATTAGCGTG

AAGTGTGAGAAAATCAGCACTTTTATCTTGTGAGAACAAGATCATCTCCTT

TAAGGAAATGAACCCCCCCGATAACATCAAGGACACCAAGTCCGATATCA

TCTTCTTCCAGCGGTCCGTGCCCGGTCACGATAACAAGATGCAGTTCGAA

TCCTCCTCCTACGAGGGCTACTTTTTAGCTTGTGAAAAGGAGAGGGATTT

ATTCAAGCTGATCCTCAAGAAGGAGGACGAGCTGGGCGATCGTTCCATCA

TGTTCACCGTCCAAAACGAGGAT (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG

The nucleic acid sequence of the IL-12/TF/IL-15 construct (including leader sequence) is as follows (SEQ ID NO: 321):

(Signal peptide)
ATGAAATGGGTGACCTTTATTTCTTTACTGTTCCTCTTTAGCAGCGCCT

ACTCC

-continued
(Human IL-12 subunit beta (p40))
ATTTGGGAACTGAAGAAGGACGTCTACGTGGTCGAACTGGACTGGTAT

CCCGATGCTCCCGGCGAAATGGTGGTGCTCACTTGTGACACCCCCGAAGA

AGACGGCATCACTTGGACCCTCGATCAGAGCAGCGAGGTGCTGGGCTCCG

GAAAGACCCTCACAATCCAAGTTAAGGAGTTCGGAGACGCTGGCCAATAC

ACATGCCACAAGGGAGGCGAGGTGCTCAGCCATTCCTTATTATTATTACA

CAAGAAGGAAGACGGAATCTGGTCCACCGACATTTTAAAAGATCAGAAGG

AGCCCAAGAATAAGACCTTTTTAAGGTGTGAGGCCAAAAACTACAGCGGT

CGTTTCACTTGTTGGTGGCTGACCACCATTTCCACCGATTTAACCTTCTC

CGTGAAAAGCAGCCGGGGAAGCTCCGACCCTCAAGGTGTGACATGTGGAG

CCGCTACCCTCAGCGCTGAGAGGGTTCGTGGCGATAACAAGGAATACGAG

TACAGCGTGGAGTGCCAAGAAGATAGCGCTTGTCCCGCTGCCGAAGAATC

TTTACCCATTGAGGTGATGGTGGACGCCGTGCACAAACTCAAGTACGAGA

ACTACACCTCCTCCTTCTTTATCCGGGACATCATTAAGCCCGATCCTCCT

AAGAATTTACAGCTGAAGCCTCTCAAAAATAGCCGGCAAGTTGAGGTCTC

TTGGGAATATCCCGACACTTGGAGCACACCCCACAGCTACTTCTCTTTAA

CCTTTTGTGTGCAAGTTCAAGGTAAAAGCAAGCGGGAGAAGAAAGACCGG

GTGTTTACCGACAAAACCAGCGCCACCGTCATCTGTCGGAAGAACGCCTC

CATCAGCGTGAGGGCTCAAGATCGTTATTACTCCAGCAGCTGGTCCGAGT

GGGCCAGCGTGCCTTGTTCC (Linker)
GGCGGTGGAGGATCCGGAGGAGGTGGCTCCGGCGGCGGAGGATCT (Human IL-12 subunit alpha (p35))
CGTAACCTCCCCGTGGCTACCCCCGATCCCGGAATGTTCCCTTGTTTAC

ACCACAGCCAGAATTTACTGAGGGCCGTGAGCAACATGCTGCAGAAAGCT

AGGCAGACTTTAGAATTTTACCCTTGCACCAGCGAGGAGATCGACCATGA

AGATATCACCAAGGACAAGACATCCACCGTGGAGGCTTGTTTACCTCTGG

AGCTGACAAAGAACGAGTCTTGTCTCAACTCTCGTGAAACCAGCTTCATC

ACAAATGGCTCTTGTTTAGCTTCCCGGAAGACCTCCTTTATGATGGCTTT

ATGCCTCAGCTCCATCTACGAGGATTTAAAGATGTACCAAGTGGAGTTCA

AGACCATGAACGCCAAGCTGCTCATGGACCCTAAACGGCAGATCTTTTTA

GACCAGAACATGCTGGCTGTGATTGATGAGCTGATGCAAGCTTTAAACTT

CAACTCCGAGACCGTCCCTCAGAAGTCCTCCCTCGAGGAGCCCGATTTTT

ACAAGACAAAGATCAAACTGTGCATTTTACTCCACGCCTTTAGGATCCGG

GCCGTGACCATTGACCGGGTCATGAGCTATTTAAACGCCAGC (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC

Example 19: Secretion of IL-18/IL-15RαSu and IL-12/TF/IL-15 Fusion Proteins

The IL-18/IL-15RαSu and IL-12/TF/IL-15 constructs were cloned into a pMSGV-1 modified retrovirus expression vector (Hughes, *Hum Gene Ther* 16:457-72, 2005 herein incorporated by reference), and the expression vector was transfected into CHO-K1 cells. Co-expression of the two constructs in CHO-K1 cells resulted in secretion of a soluble IL-12/TF/IL-15:IL-18/IL-15RαSu protein complex (referred to as 12t15/s18), which can be purified by anti-TF Ab affinity and other chromatography methods.

The amino acid sequence of the IL-18/IL-15RαSu fusion protein (including signal peptide sequence) is as follows (SEQ ID NO: 322):

(Signal peptide)
MKWVTFISLLFLFSSAYS (Human IL-18)
YFGKLESKLSVIRNLNDQVLFIDQGNRPLFEDMTDSDCRDNAPRTIFII
SMYKDSQPRGMAVTISVKCEKISTLSCENKIISFKEMNPPDNIKDTKSD
IIFFQRSVPGHDNKMQFESSSYEGYFLACEKERDLFKLILKKEDELGDR
SIMFTVQNED (Human IL-15R a sushi domain)
ITCPPPMSVEHADIWVKSYSLYSRERYICNSGFKRKAGTSSLTECVLNK
ATNVAHWTTPSLKCIR The amino acid sequence of the IL-12/TF/IL-15 fusion protein (including leader sequence) is as follows (SEQ ID NO: 323):

(Signal peptide)
MKWVTFISLLFLFSSAYS (Human IL-12 subunit beta (p40))
IWELKKDVYVVELDWYPDAPGEMVVLTCDTPEEDGITWTLDQSSEVLGS
GKTLTIQVKEFGDAGQYTCHKGGEVLSHSLLLLHKKEDGIWSTDILKDQK
EPKNKTFLRCEAKNYSGRFTCWWLTTISTDLTFSVKSSRGSSDPQGVTCG -continued
AATLSAERVRGDNKEYEYSVECQEDSACPAAEESLPIEVMVDAVHKLKYE

NYTSSFFIRDIIKPDPPKNLQLKPLKNSRQVEVSWEYPDTWSTPHSYFSL

TFCVQVQGKSKREKKDRVFTDKTSATVICRKNASISVRAQDRYYSSSWSE

WASVPCS (Linker)
GGGGSGGGGSGGGGS (Human IL-12 subunit alpha (p35))
RNLPVATPDPGMFPCLHHSQNLLRAVSNMLQKARQTLEFYPCTSEEIDHE

DITKDKTSTVEACLPLELTKNESCLNSRETSFITNGSCLASRKTSFMMAL

CLSSIYEDLKMYQVEFKTMNAKLLMDPKRQIFLDQNMLAVIDELMQALNF

NSETVPQKSSLEEPDFYKTKIKLCILLHAFRIRAVTIDRVMSYLNAS (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

In some cases, the leader peptide is cleaved from the intact polypeptide to generate the mature form that may be soluble or secreted.

Example 20: Recombinant Protein Quantitation of the 18t15-12s16 Complex

Figure 39:
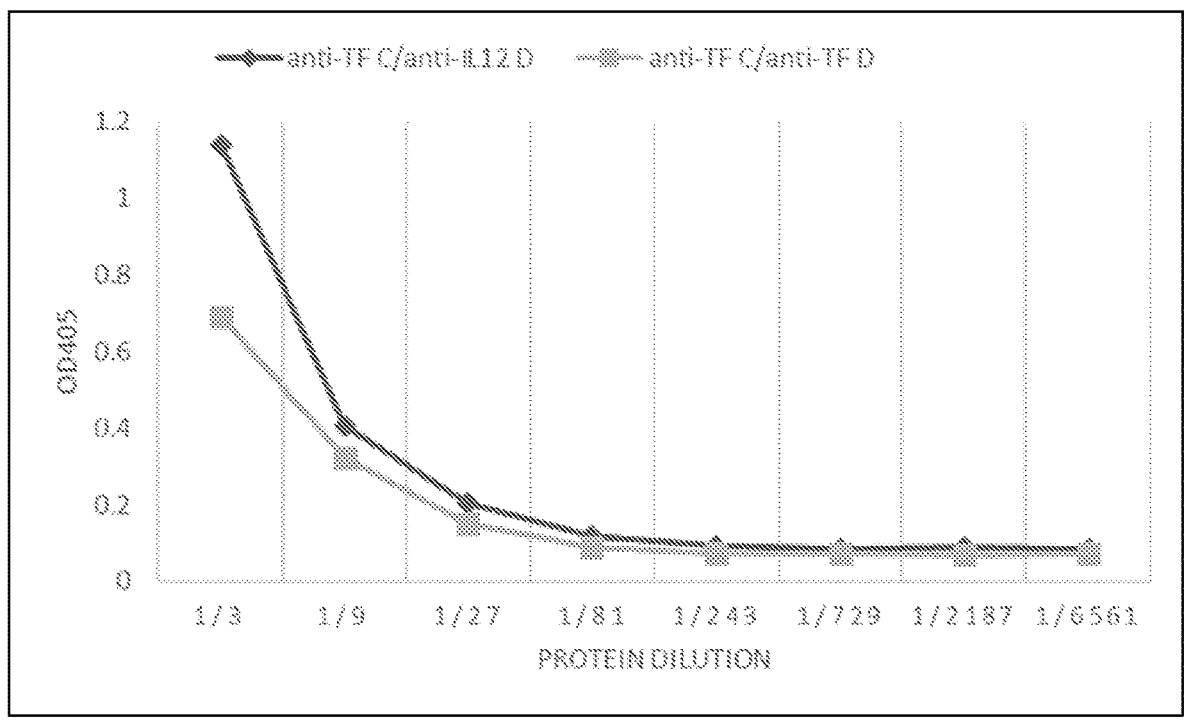
FIG. 39 shows a sandwich ELISA for the 18t15-12s16 complex, comprising an anti-human tissue factor antibody capture antibody and a biotinylated anti-human IL-12 (BAF 219) (dark line) or an anti-human tissue factor detection antibody (light line).

The 18t15-12s16 complex (comprising IL-12/IL-15RαSu/αCD16scFv; IL-18/TF/IL-15) was detected and quantified using standard sandwich ELISA methods (FIG. 39). Anti-human tissue factor antibody/IL-2 or anti-TF Ab/IL-18 served as the capture antibody and biotinylated anti-human IL-12 or IL-18 antibody (BAF 219, D045-6, both R&D Systems) served as the detection antibody. Tissue factor was also detected using an anti-human tissue factor antibody (143), and anti-human tissue factor antibody detection.

Example 21: Creation of TGFβRII/IL-15RαSu and IL-21/TF/IL-15 DNA Constructs

Figure 40:
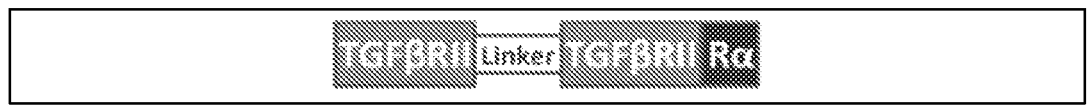
FIG. 40 shows a schematic diagram of an exemplary TGFβRII/IL-15RαSu DNA construct.

In a non-limiting example, a TGFβRII/IL-15RαSu DNA construct was created (FIG. 40). The human TGFβRII dimer and human IL-21 sequences were obtained from the UniProt website and DNA for these sequences was synthesized by Genewiz. A DNA construct was made linking the TGFβRII to another TGFβRII with a linker to generate a single chain version of TGFβRII and then directly linking the TGFβRII single chain dimer sequence to the N-terminal coding region of IL-15RαSu.

The nucleic acid sequences of the TGFβRII/IL-15RαSu construct (including signal sequence) is as follows (SEQ ID NO: 196):

(Signal peptide)
ATGAAGTGGGTGACCTTCATCAGCCTGCTGTTCCTGTTCTCCAGCGCCT

ACTCC (Human TGF βRII-1$^{st}$ fragment)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCACGA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG

CAACCCTGAT (Linker)
GGAGGTGGCGGATCCGGAGGTGGAGGTTCTGGTGGAGGTGGGAGT (Human TGF βRII-2$^{nd}$ fragment)
ATTCCTCCCCACGTGCAGAAGAGCGTGAATAATGACATGATCGTGACC

GATAACAATGGCGCCGTGAAATTTCCCCAGCTGTGCAAATTCTGCGATGT

GAGGTTTTCCACCTGCGACAACCAGAAGTCCTGTATGAGCAACTGCACAA

TCACCTCCATCTGTGAGAAGCCTCAGGAGGTGTGCGTGGCTGTCTGGCGG

AAGAATGACGAGAATATCACCCTGGAAACCGTCTGCCACGATCCCAAGCT

GCCCTACCACGATTTCATCCTGGAAGACGCCGCCAGCCCTAAGTGCATCA

TGAAAGAGAAAAAGAAGCCTGGCGAGACCTTTTTCATGTGCTCCTGCAGC

AGCGACGAATGCAACGACAATATCATCTTTAGCGAGGAATACAATACCAG

CAACCCCGAC (Human IL-15R α sushi domain)
ATCACGTGTCCTCCTCCTATGTCCGTGGAACACGCAGACATCTGGGTC

AAGAGCTACAGCTTGTACTCCAGGGAGCGGTACATTTGTAACTCTGGTTT

CAAGCGTAAAGCCGGCACGTCCAGCCTGACGGAGTGCGTGTTGAACAAGG

CCACGAATGTCGCCCACTGGACAACCCCCAGTCTCAAATGTATTAGA

Figure 41:
FIG. 41 shows a schematic diagram of an exemplary IL-21/TF/IL-15 construct.

Additionally, an IL-21/TF/IL-15 construct was made linking the IL-21 sequence to the N-terminus coding region of tissue factor 219, and further linking the IL-21/TF construct to the N-terminus coding region of IL-15 (FIG. 41). The nucleic acid sequence of the IL-21/TF/IL-15 construct (including leader sequence) is as follows (SEQ ID NO: 192):

(Signal peptide)
ATGAAGTGGGTGACCTTCATCAGCCTGCTGTTCCTGTTCTCCAGCGCCT

ACTCC (Human IL-21)
CAGGGCCAGGACAGGCACATGATCCGGATGAGGCAGCTCATCGACAT

CGTCGACCAGCTGAAGAACTACGTGAACGACCTGGTGCCCGAGTTTCTGC

CTGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGAT

CATCAACGTGAGCATCAAGAAGCTGAAGCGGAAGCCTCCCTCCACAAACG

-continued
```
CCGGCAGGAGGCAGAAGCACAGGCTGACCTGCCCCAGCTGTGACTCCTAC

GAGAAGAAGCCCCCAAGGAGTTCCTGGAGAGGTTCAAGTCCCTGCTGCA

GAAGATGATCCATCAGCACCTGTCCTCCAGGACCCACGGCTCCGAGGACT

CC (Human Tissue Factor 219)
TCCGGCACCACCAATACCGTGGCCGCTTATAACCTCACATGGAAGAGC

ACCAACTTCAAGACAATTCTGGAATGGGAACCCAAGCCCGTCAATCAAGT

TTACACCGTGCAGATCTCCACCAAATCCGGAGACTGGAAGAGCAAGTGCT

TCTACACAACAGACACCGAGTGTGATTTAACCGACGAAATCGTCAAGGAC

GTCAAGCAAACCTATCTGGCTCGGGTCTTTTCCTACCCCGCTGGCAATGT

CGAGTCCACCGGCTCCGCTGGCGAGCCTCTCTACGAGAATTCCCCCGAAT

TCACCCCTTATTTAGAGACCAATTTAGGCCAGCCTACCATCCAGAGCTTC

GAGCAAGTTGGCACCAAGGTGAACGTCACCGTCGAGGATGAAAGGACTTT

AGTGCGGCGGAATAACACATTTTTATCCCTCCGGGATGTGTTCGGCAAAG

ACCTCATCTACACACTGTACTATTGGAAGTCCAGCTCCTCCGGCAAAAAG

ACCGCTAAGACCAACACCAACGAGTTTTTAATTGACGTGGACAAAGGCGA

GAACTACTGCTTCAGCGTGCAAGCCGTGATCCCTTCTCGTACCGTCAACC

GGAAGAGCACAGATTCCCCCGTTGAGTGCATGGGCCAAGAAAAGGGCGAG

TTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC
```

Figure 42:
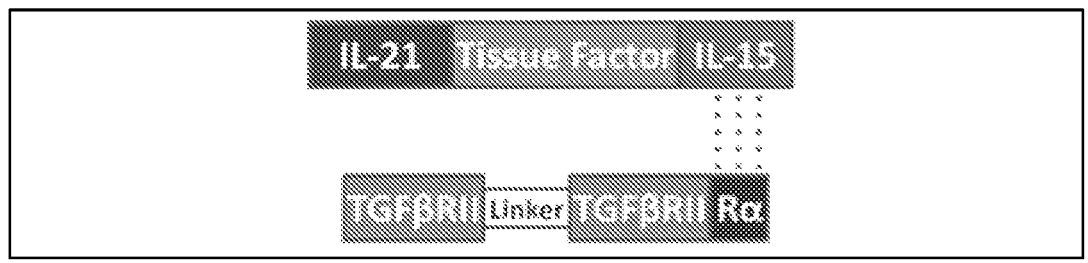
FIG. 42 shows a schematic diagram of the interaction between the exemplary IL-IL-21/TF/IL-15 and TGFβRII/IL-15RαSu constructs.
Figure 43:
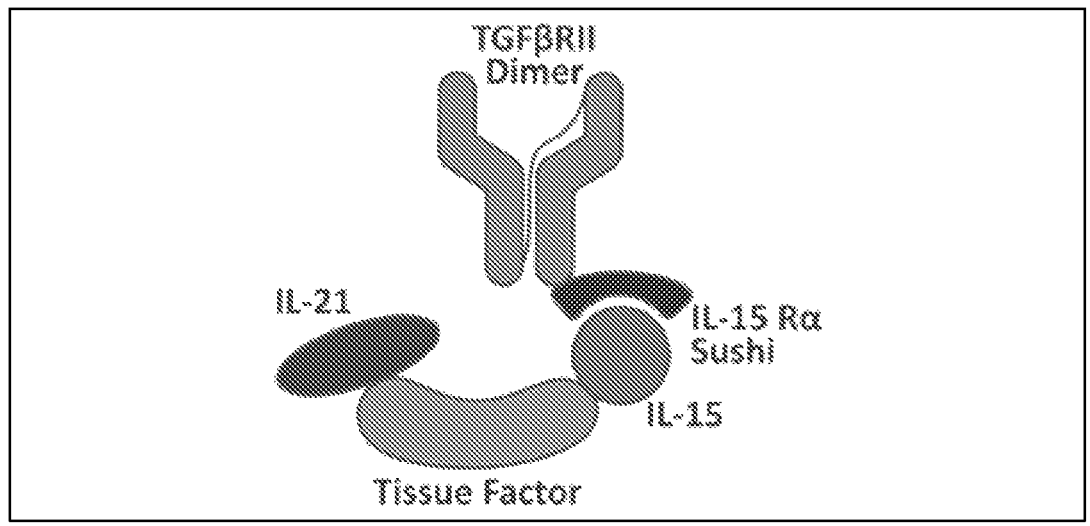
FIG. 43 shows a schematic diagram of the interaction between the exemplary TGFβRII/IL-15RαSu and IL-21/TF/IL-15 fusion proteins, resulting in an IL-21/TF/IL-15/TGFβRII/IL-15RαSu complex (21t15-TGFRs).

Example 22: Secretion of TGFβRII/IL-15RαSu and IL-21/TF/IL-15 Fusion Proteins The TGFβRII/IL-15RαSu and IL-21/TF/IL-15 DNA constructs were cloned into a pMSGV-1 modified retrovirus expression vector (as described in Hughes et al., Hum Gene Ther 16:457-72, 2005, herein incorporated by reference), and the expression vector was transfected into CHO-K1 cells. Co-expression of the two constructs in CHO-K1 cells resulted in secretion of the soluble IL-21/TF/IL-15: TGFβRII/IL-15RαSu protein complex (referred to as 21t15-TGFRs; FIG. 42 and FIG. 43). The 21t15-TGFRs complex was purified from CHO-K1 cell culture supernatant using anti-TF antibody affinity chromatography and other chromatography methods.

The amino acid sequence of the TGFβRII/IL-15RαSu construct (including signal peptide sequence) is as follows (SEQ ID NO: 195):

```
(Signal peptide)
MKWVTFISLLFLFSSAYS (Human TGF βRII-1st fragment)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD (Linker)
GGGGSGGGGSGGGGS (Human TGF βRII-2nd fragment)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD (Human IL-15R α sushi domain)
ITCPPPMSVEHADIWVKSYSLYSRERYICNSGFKRKAGTSSLTECVLNKA

TNVAHWTTPSLKCIR
```

The amino acid sequence of the mature IL-21/TF/IL-15 fusion protein (including signal peptide sequence) is as follows (SEQ ID NO: 191):

```
(Signal peptide)
MKWVTFISLLFLFSSAYS (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS
```

In some cases, the leader peptide is cleaved from the intact polypeptide to generate a mature form that may be soluble or secreted.

Example 23: Purification of 21t15-TGFRs by Immunoaffinity Chromatography

An anti-TF antibody affinity column was connected to a GE Healthcare AKTA™ Avant protein purification system. The flow rate was 4 mL/min for all steps except the elution step, which was 2 mL/min.

Figure 44:
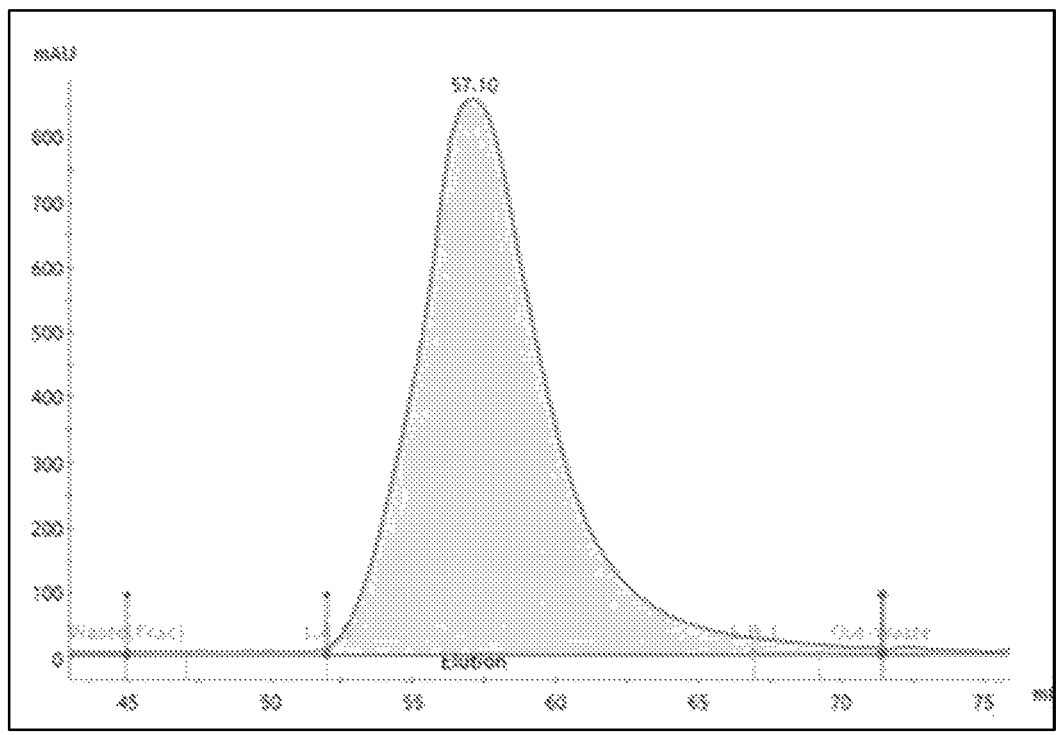
FIG. 44 shows a chromatograph of 21t15-TGFRs purification elution from an anti-TF antibody affinity column.
Figure 45:
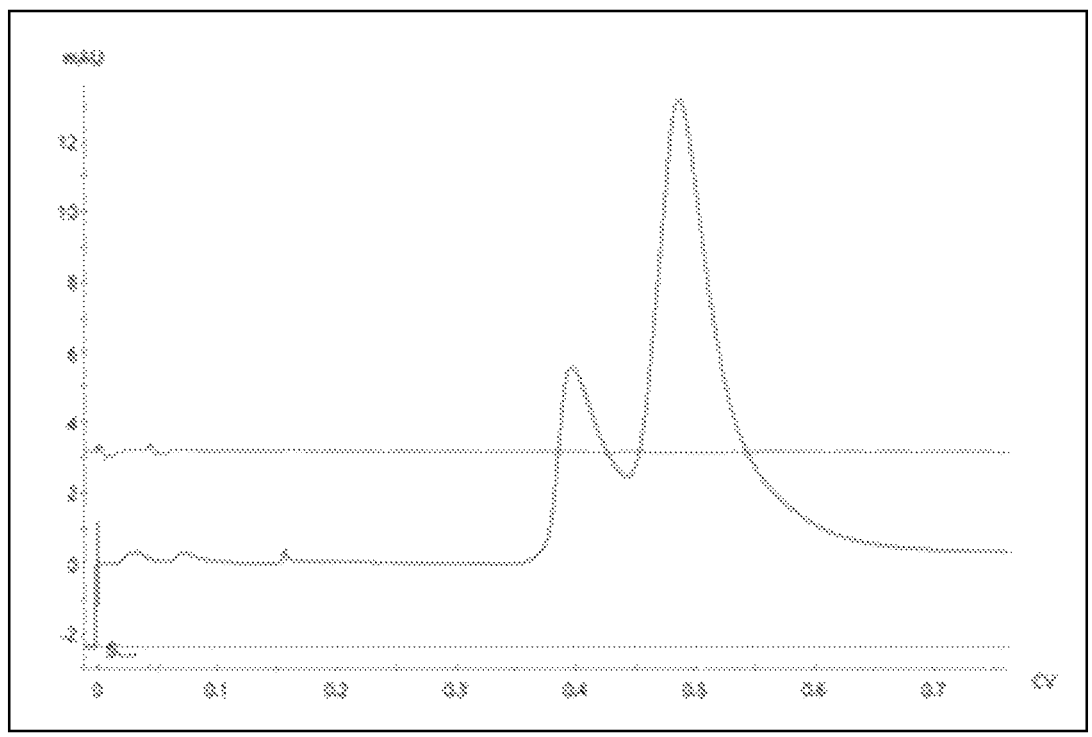
FIG. 45 shows an exemplary 21t15-TGFRs size exclusion chromatograph showing a main protein peak and a high molecular weight peak
Figure 46:
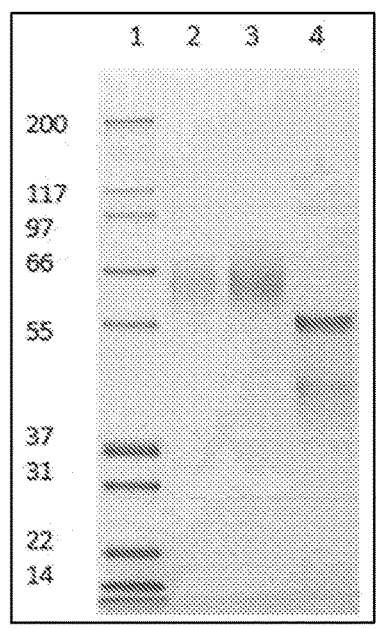
FIG. 46 shows an example of a 4-12% SDS-PAGE of the 21t15-TGFRs complex following disulfide bond reduction. Lane 1: Mark12 unstained marker (numbers on the left side indicate molecular weights in kDa); Lane 2: 21t15-TGFRs (0.5 µg); Lane 3: 21t15-TGFRs (1 jig); Lane 4: 21t15-TGFRs, deglycosylated (1 µg), wherein the MW was the expected size of 53 kDa and 39.08 kDa.
Figure 47:
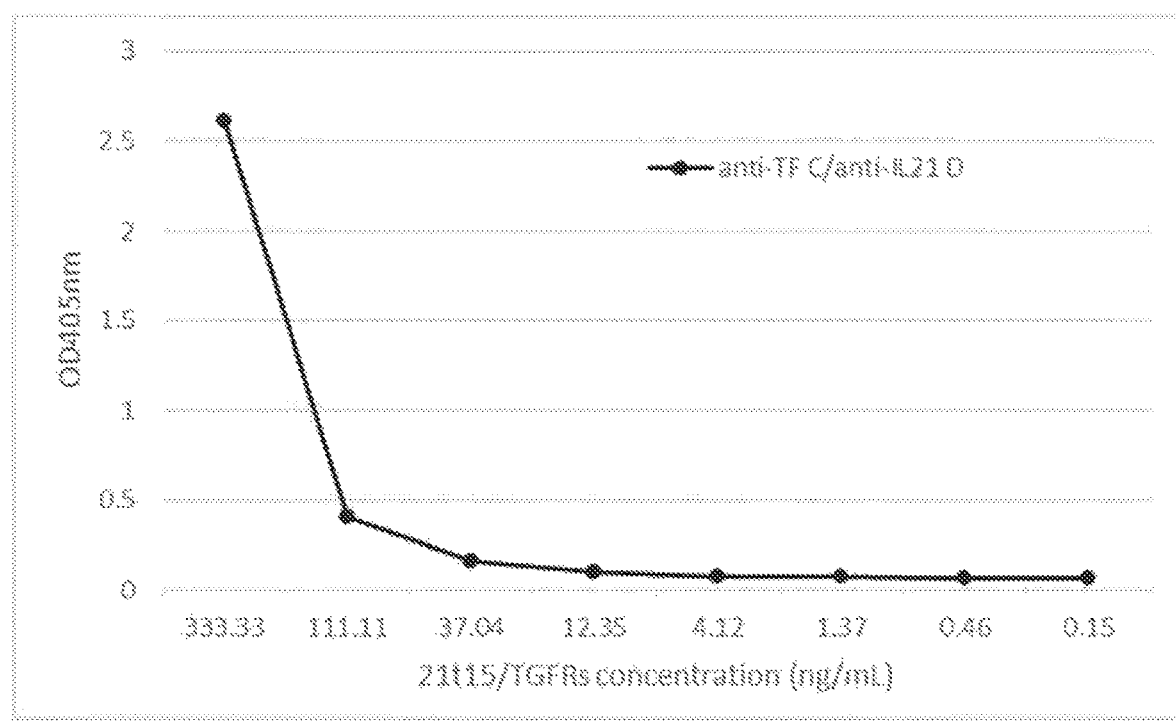
FIG. 47 shows a sandwich ELISA for the 21t15-TGFRs complex, comprising an anti-human tissue factor capture and a biotinylated anti-human IL-21 detection antibody (13-7218-81, BioLegend).
Figure 48:

FIG. 48 shows a sandwich ELISA for the 21t15-TGFRs complex, comprising an anti-human tissue factor antibody capture and a biotinylated anti-human IL-15 detection antibody (BAM 247, R&D Systems).
Figure 49:
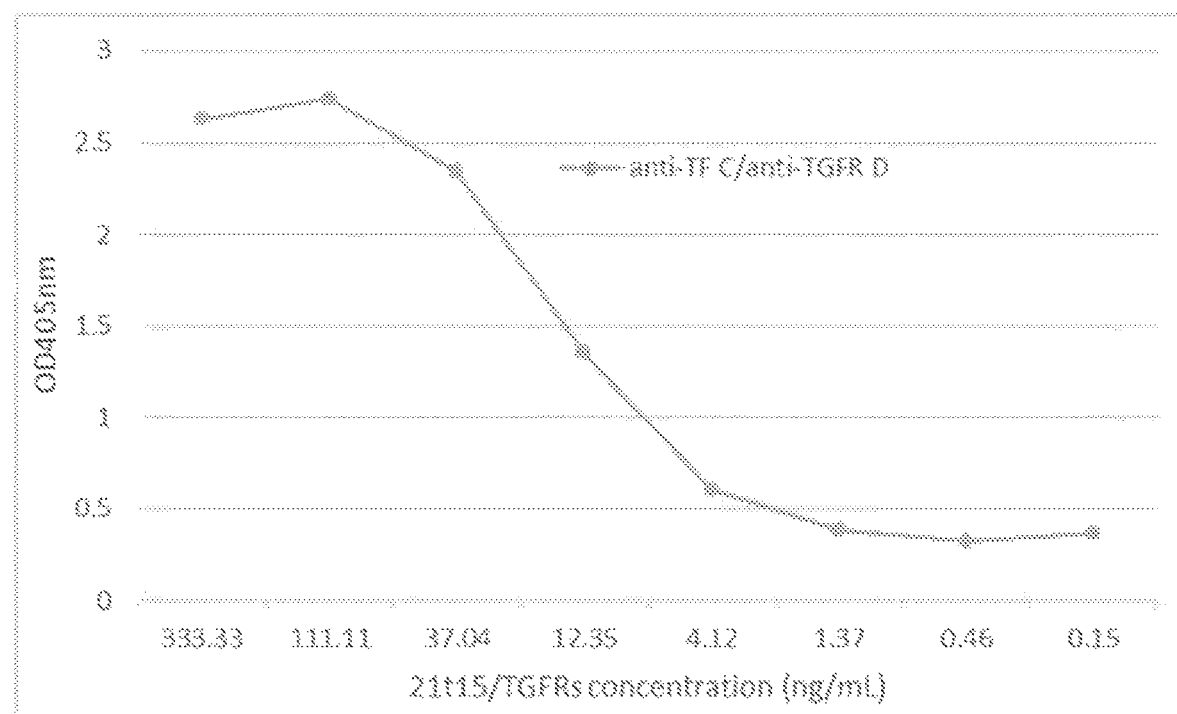
FIG. 49 shows a sandwich ELISA for the 21t15-TGFRs complex, comprising an anti-human tissue factor antibody capture and a biotinylated anti-human TGFβRII detection antibody (BAF241, R&D Systems).
Figure 50:
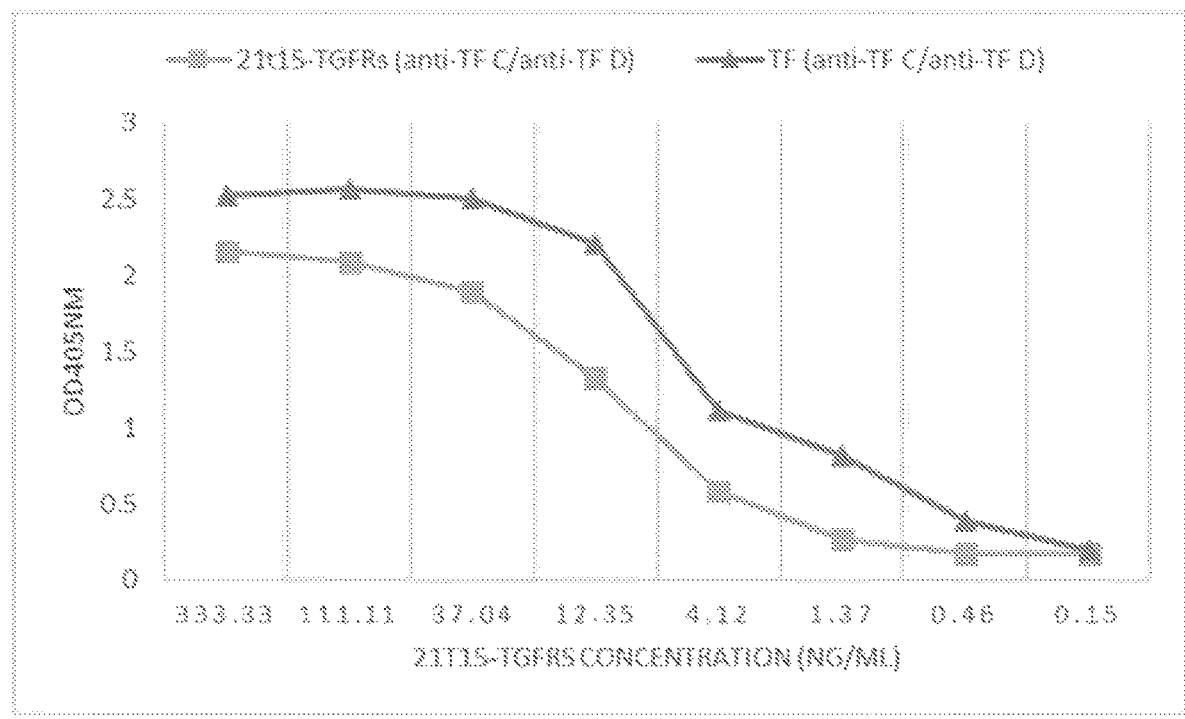
FIG. 50 shows a sandwich ELISA for the 21t15-TGFRs complex, comprising an anti-human tissue factor (I43) capture antibody and an anti-human tissue factor detection antibody.
Figure 51:
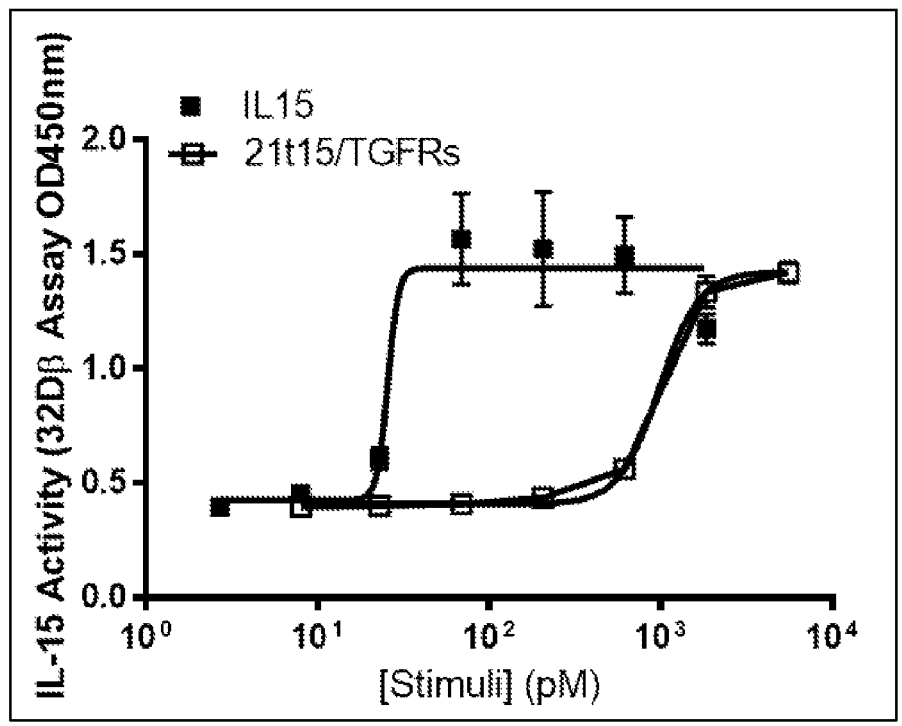
FIG. 51 shows IL-15-dependent proliferation of 32Dβ cells mediated by the 21t15-TGFRs complex (open squares) compared to IL-15 (black squares).
Figure 52:
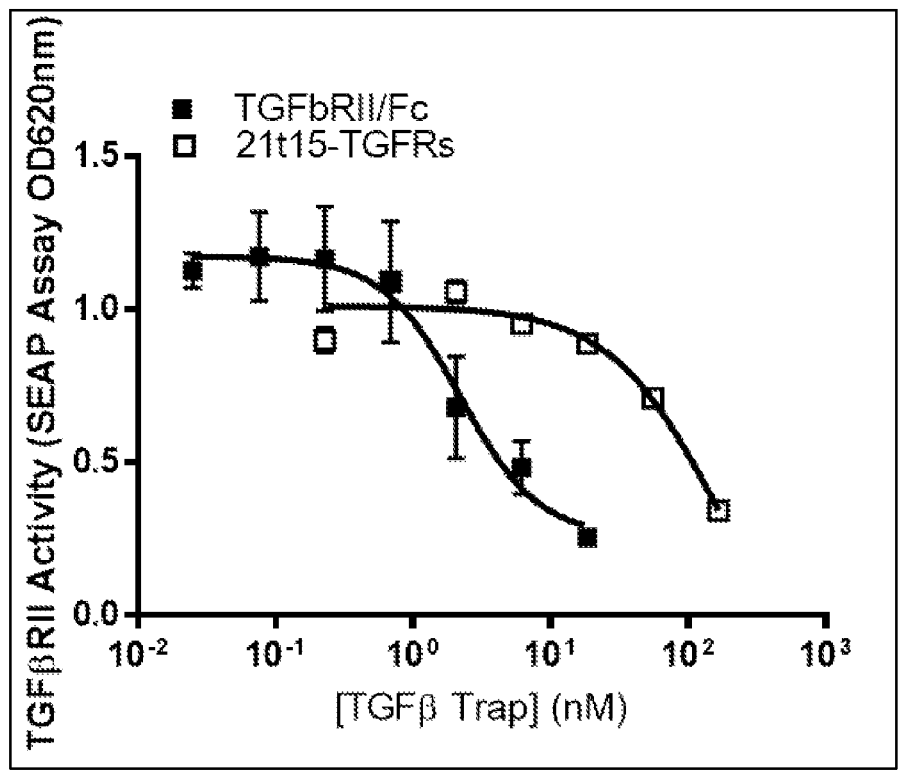
FIG. 52 shows biological activity of the TGFβRII domain within the 21t15-TGFRs complex (open squares). TGFβRII/Fc (black squares) served as a positive control.
Figure 53:
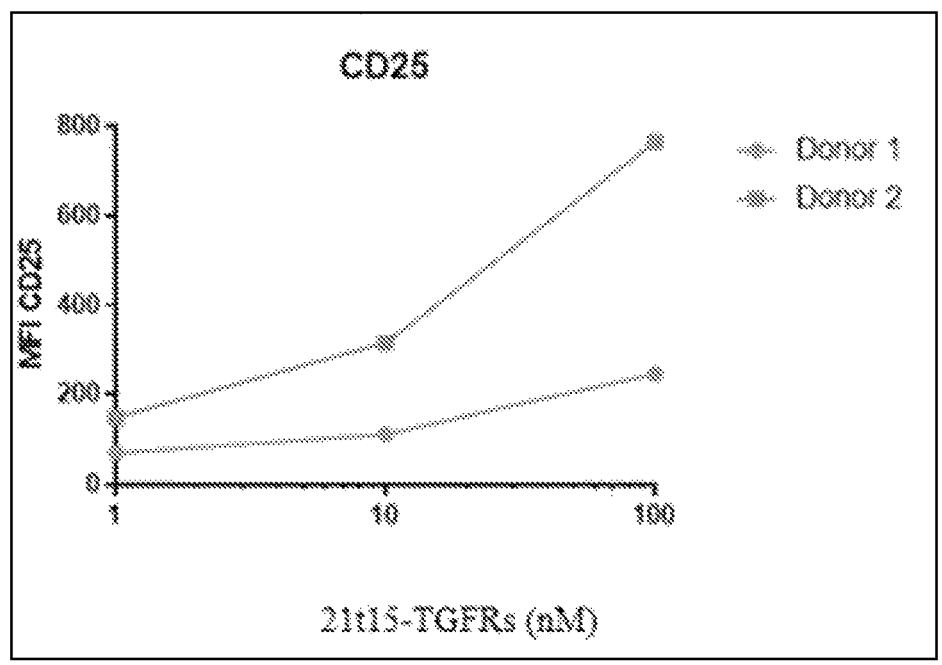
FIG. 53 shows a flow cytometry graph of cell-surface CD25 expression of NK cells induced by the 21t15-TGFRs complex.
Figure 54:
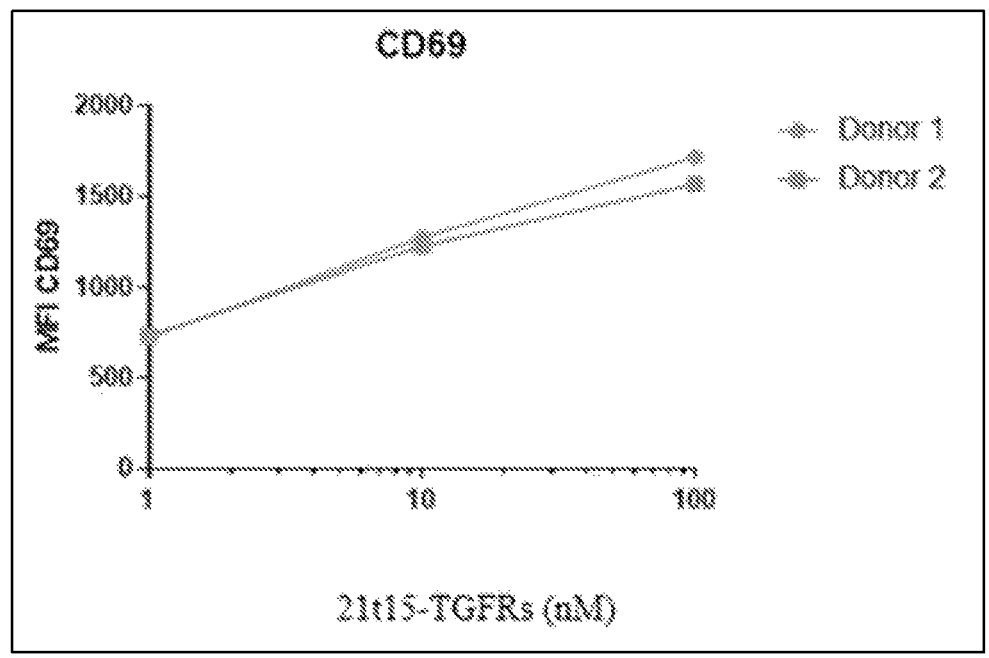
FIG. 54 shows a flow cytometry graph of cell-surface CD69 expression of NK cells induced by the 21t15-TGFRs complex.

Cell culture harvest of 21t15-TGFRs was adjusted to pH 7.4 with 1M Tris base and loaded onto the anti-TF antibody affinity column equilibrated with 5 column volumes of PBS. After loading the sample, the column was washed with 5 column volumes PBS, followed by elution with 6 column volumes 0.1M acetic acid, pH 2.9. Absorbance at 280 nm was collected and then the sample was then neutralized to pH 7.5-8.0 by adding 1M Tris base. The neutralized sample was then buffer exchanged into PBS using Amicon® centrifugal filters with a 30 KDa molecular weight cutoff. FIG. 44 shows that the 21t15-TGFRs complex binds anti-TF antibody affinity column, wherein TF is a 21t15-TGFRs binding partner. The buffer-exchanged protein sample is stored at 2-8° C. for further biochemical analysis and biological activity testing.

After each elution, the anti-TF antibody affinity column was then stripped using 6 column volumes 0.1M glycine, pH 2.5. The column was then neutralized using 10 column volumes PBS, 0.05% sodium azide, and stored at 2-8° C.

Example 24: Size Exclusion Chromatography of 21t15-TGFRs

A GE Healthcare Superdex® 200 Increase 10/300 GL gel filtration column was connected to a GE Healthcare AKTA™ Avant protein purification system. The column was equilibrated with 2 column volumes of PBS. The flow rate was 0.8 mL/min. A capillary loop was used to inject 200 μL of 1 mg/mL of 21t15-TGFRs complex onto the column. The injection was then chased with 1.25 column volumes of PBS. The SEC chromatograph was shown in FIG. 45. There were two protein peaks, likely representing a monomer and dimer forms of 21t15-TGFRs.

Example 25: SDS-PAGE of 21t15-TGFRs

To determine the purity and protein molecular weight, the purified 21t15-TGFRs complex protein sample was analyzed using 4-12% NuPage Bis-Tris protein gel SDS-PAGE under reduced conditions. The gel was stained with InstantBlue™ for about 30 min, followed by destaining overnight in purified water. FIG. 46 shows an example SDS gel of anti-TF antibody affinity purified 21t15-TGFRs, with bands at 39.08 kDa and 53 kDa Glycosylation of 21t15-TGFRs in CHO cells was confirmed using the Protein Deglycosylation Mix II kit (New England Biolabs) and the manufacturer's instructions. Deglycosylation reduces the molecular weight of 21t15-TGFRs, as seen in lane 4 of FIG. 46.

Example 26: Recombinant Protein Quantitation of 21t15-TGFRs Complexes

The 21t15-TGFRs complex was detected and quantified using standard sandwich ELISA methods (FIGS. 47-50). Anti-human tissue factor antibody served as the capture antibody and biotinylated anti-human IL-21, IL-15, or TGFβRII served as the detection antibody. Tissue factor was also detected using an anti-human tissue factor capture antibody (143), and anti-human tissue factor antibody detection. The I43/anti-TF antibody ELISA was compared to purified tissue factor at similar concentrations.

Example 27: Immunostimulatory Capacity of the 21t15-TGFRs Complex

To assess the IL-15 immunostimulatory activity of the 21t15-TGFRs complexes, increasing concentrations of 21t15-TGFRs was added to 32Dβ cells ($10^4$ cell/well) in 200 μL IMDM:10% FBS media and cells were incubated for 3 days at 37° C. On the fourth day, WST-1 proliferation reagent (10 μL/well) then was added and after 4 hours, absorbance was measured at 450 nm to determine cell proliferation based on cleavage of WST-1 to a soluble formazan dye. Bioactivity of the human recombinant IL-15 was assessed as a positive control. As shown in FIG. 51, 21t15-TGFRs demonstrated IL-15-dependent 32143 cell proliferation. The 21t15-TGFRs complex was reduced compared to that of human recombinant IL-15, possibly due to the linkage of IL-21 and tissue factor to the IL-15 domain.

Additionally, HEK-Blue TGFβ reporter cells (hkb-tgfb, InvivoGen) were used to measure the ability of 21t15-TGFRs to block TGFβ1 activity (FIG. 52). Increasing concentrations of 21t15-TGFRs were mixed with 0.1 nM of TGFβ1 and added to HEK-Blue TGFβ reporter cells (2.5×$10^4$ cell/well) in 200 μL IMDM:10% heat-inactivated FBS media. Cells were incubated overnight at 37° C. The next day, 20 μl of induced HEK-Blue TGFβ reporter cell supernatant was added to 180 μl of QUANTI-Blue (InvivoGen) and incubated for 1-3 hours at 37° C. 21t15-TGFRs activity was assessed by measuring absorbance at 620 nm. Human recombinant TGFβRII/Fc activity was assessed as a positive control.

These results demonstrate that TGFβRII domain of the 21t15-TGFRs complex retains its ability to trap TGFβ1. The ability of 21t15-TGFRs to block TGFβ1 activity was reduced compared to that of human recombinant TGFβRII/Fc, possibly due to the linkage of TGFβRII to the IL-15Rα sushi domain.

Example 28: Induction of Cytokine-Induced Memory-Like NK Cells by the 21t15-TGFRs Complex Cytokine-induced memory-like NK cells can be induced ex vivo following overnight stimulation of purified NK cells with saturating amounts of cytokines. These memory-like properties can be measured through expression of IL-2 receptor a (IL-2Rα, CD25), CD69 (and other activation markers), and increased IFN-γ production. To evaluate the ability of 21t15-TGFRs complexes to promote generation of cytokine-induced memory-like NK cells, purified human NK cells (>95% CD56+) were stimulated for 14-18 hours with 1 nM to 100 nM of the 21t15-TGFRs complex. Cell-surface CD25 and CD 69 expression and intracellular IFN-γ levels were assessed by antibody-staining and flow cytometry.

Fresh human leukocytes were obtained from a blood bank and CD56+NK cells were isolated with the RosetteSep/human NK cell reagent (StemCell Technologies). The purity of NK cells was >70% and confirmed by staining with CD56-BV421, CD16-BV510, CD25-PE, CD69-APC-Fire750 specific antibodies (BioLegend). Cells were counted and resuspended in 0.2×$10^6$/mL in a 96 well flat bottom plate in 0.2 mL of complete media (RPMI 1640 (Gibco), supplemented with 2 mM L-glutamine (Thermo Life Technologies), penicillin (Thermo Life Technologies), streptomycin (Thermo Life Technologies), and 10% FBS (Hyclone)). Cells were stimulated with either mix-cytokines of hIL-21 (50 ng/ml) (Biolegend) and hIL-15 (50 ng/ml) (NCI) or with 1 nM, 10 nM, or 100 nM 21t15-TGFRs complex overnight at 37° C., 5% $CO_2$ for 14-18 hrs. The cells were then harvested and surface stained for CD56-BV421, CD16-BV510, CD25-PE, CD69-APCFire750 specific antibodies for 30 minutes. After staining, cells were washed (1500 RPM for 5 minutes at room temperature) in FACS buffer (1×PBS (Hyclone) with 0.5% BSA (EMD Millipore) and 0.001% sodium azide (Sigma)). After two washes, cells were analyzed using a BD FACSCelesta™ flow cytometer. (Plotted Data-Mean Fluorescence Intensity; FIG. 53 and FIG. 54).

Figure 55:
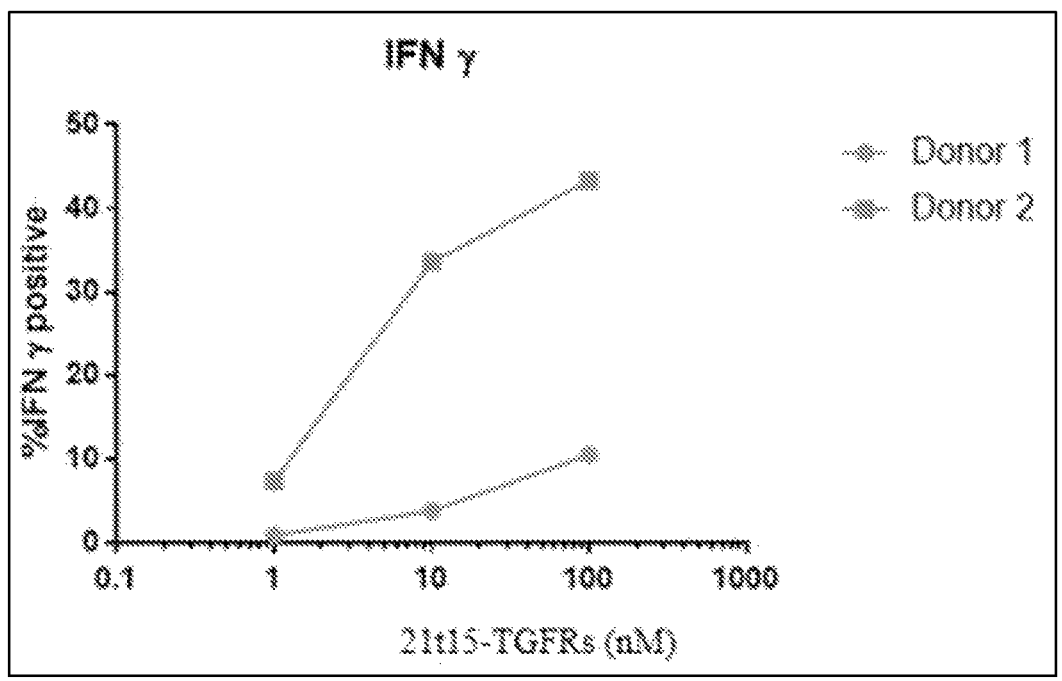
FIG. 55 shows a flow cytometry graph of intracellular IFN-γ expression of NK cells induced by the 21t15-TGFRs complex.

Fresh human leukocytes were obtained from a blood bank and CD56+ NK cells were isolated with the RosetteSep/ human NK cell reagent (StemCell Technologies). The purity of NK cells was >70% and confirmed by staining with CD56-BV421, CD16-BV510, CD25-PE, CD69-APC-Fire750 specific antibodies (BioLegend). Cells were counted and resuspended in 0.2×106/ml in a 96 well flat bottom plate in 0.2 mL of complete media (RPMI 1640 (Gibco), supplemented with 2 mM L-glutamine (Thermo Life Technologies), penicillin (Thermo Life Technologies), streptomycin (Thermo Life Technologies), and 10% FBS (Hyclone)). Cells were stimulated with either mix-cytokines of hIL-21 (50 ng/ml) (Biolegend) and hIL-15 (50 ng/ml) (NCI) or with 1 nM, 10 nM, or 100 nM 21t15-TGFRs complex overnight at 37° C., 5% $CO_2$ for 14-18 hrs. The cells were then treated with 10 µg/ml of Brefeldin A (Sigma) and 1× of Monensin (eBioscience) for 4 hrs. Cells were harvested and surface stained for CD56-BV421, CD16-BV510, CD25-PE, CD69-APCFire750 specific antibodies for 30 minutes. After staining, cells were washed (1500 RPM for 5 minutes at room temperature) in FACS buffer (1×PBS (Hyclone) with 0.5% BSA (EMD Millipore) and 0.001% sodium azide (Sigma)) and fixed for 10 minutes at room temperature. After fixation, cells were washed (1500 RPM for 5 minutes at room temperature) with 1× permeabilized buffer (eBioscience) and stained for intracellular IFN-γ-PE (Biolegend) for 30 minutes at room temperature. Cells were washed once again with 1× permeabilized buffer and then washed with FACS buffer. Cell pellets were resuspended in 300 ills of FACS Buffer and analyzed using a BD FACSCelesta™ flow cytometer. (Plotted % of IFN-γ Positive Cells; FIG. 55).

Example 29: In Vitro Cytotoxicity of NK Cells Against Human Tumor Cells

Figure 56:
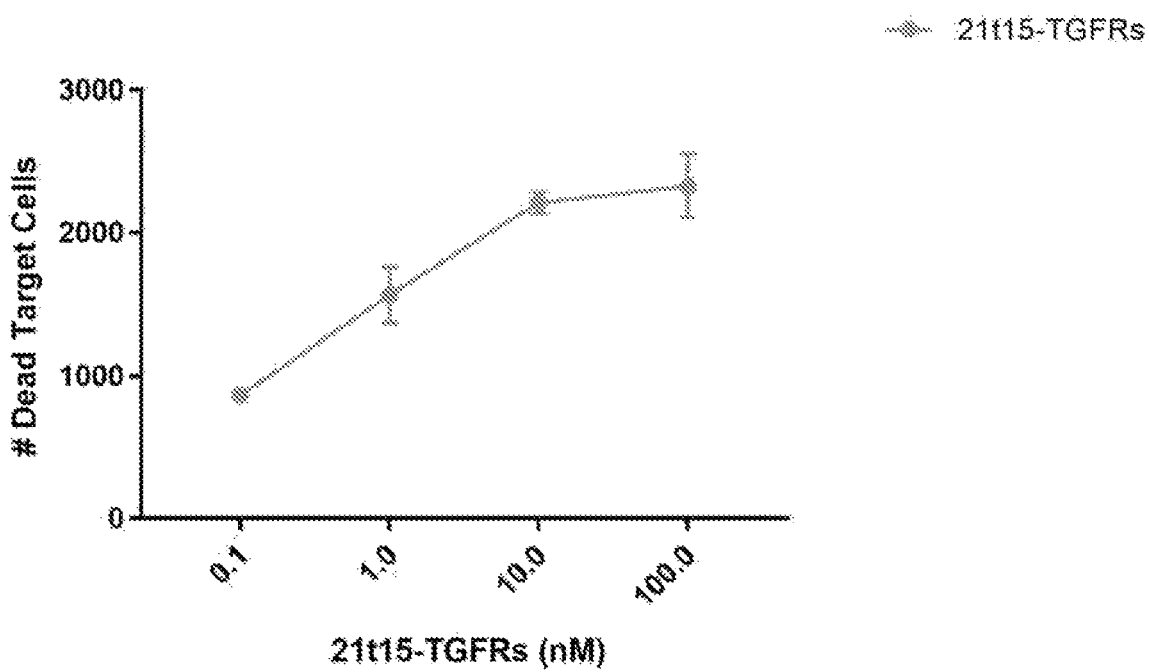
FIG. 56 shows cytotoxicity of 21t15-TGFRs-induced human NK cells against K562 cells.

K562 (CellTrace Violet labelled), human myelogenous leukemia cells, were incubated with purified human NK cells (using StemCell human NK cell purification kit (E:T ratio; 2:1)) in the presence of increasing concentrations of the 21t15-TGFRs complex. After 20 hours, the cultures were harvested, stained with propidium iodide (PI), and assessed by flow cytometry. As shown in FIG. 56, the 21t15-TGFRs complex induced human NK cytotoxicity against K562, as compared to control.

Example 30: Creation of an IL-21/TF Mutant/IL-15 DNA Construct and Resulting Fusion Protein Complex with TGFβRII/IL-15RαSu In a non-limiting example, an IL-21/TF mutant/IL-15 DNA construct was made by linking IL-21 directly to the N-terminus coding region of a tissue factor 219 mutant, and further linking the IL-21/TF mutant to the N-terminus coding region of IL-15.

The nucleic acid sequence of the IL-21/TF mutant/IL-15 construct (including signal peptide sequence) is as follows (SEQ ID NO: 324, bold nucleotides are mutant and the mutant codons are underlined):

```
(Signal sequence)
ATGAAGTGGGTGACCTTCATCAGCCTGCTGTTCCTGTTCTCCAGCGCCT
ACTCC (Human IL-21)
CAGGGCCAGGACAGGCACATGATCCGGATGAGGCAGCTCATCGACAT

CGTCGACCAGCTGAAGAACTACGTGAACGACCTGGTGCCCGAGTTTCTGC

CTGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGAT

CATCAACGTGAGCATCAAGAAGCTGAAGCGGAAGCCTCCCTCCACAAACG

CCGGCAGGAGGCAGAAGCACAGGCTGACCTGCCCCAGCTGTGACTCCTAC

GAGAAGAAGCCCCCCAAGGAGTTCCTGGAGAGGTTCAAGTCCCTGCTGCA

GAAGATGATCCATCAGCACCTGTCCTCCAGGACCCACGGCTCCGAGGACT

CC (Human Tissue Factor 219 mutants)
TCCGGCACCACCAATACCGTGGCCGCTTATAACCTCACATGGAAGAGC

ACCAACTTCGCGACAGCTCTGGAATGGGAACCCAAGCCCGTCAATCAAGT

TTACACCGTGCAGATCTCCACCAAATCCGGAGACTGGAAGAGCAAGTGCT

TCTACACAACAGACACCGAGTGTGCTTTAACCGACGAAATCGTCAAGGAC

GTCAAGCAAACCTATCTGGCTCGGGTCTTTTCCTACCCCGCTGGCAATGT

CGAGTCCACCGGCTCCGCTGGCGAGCCTCTCTACGAGAATTCCCCCGAAT

TCACCCCTTATTTAGAGACCAATTTAGGCCAGCCTACCATCCAGAGCTTC

GAGCAAGTTGGCACCAAGGTGAACGTCACCGTCGAGGATGAAAGGACTTT

AGTGGCGCGGAATAACACAGCTTATCCCTCCGGGATGTGTTCGGCAAAG

ACCTCATCTACACACTGTACTATTGGAAGTCCAGCTCCTCCGGCAAAAAG

ACCGCTAAGACCAACACCAACGAGTTTTTAATTGACGTGGACAAAGGCGA

GAACTACTGCTTCAGCGTGCAAGCCGTGATCCCTTCTCGTACCGTCAACC

GGAAGAGCACAGATTCCCCCGTTGAGTGCATGGGCCAAGAAAAGGGCGAG

TTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC
```

The amino acid sequence of the IL-21/TF mutant/IL-15 construct (including signal peptide sequence) is as follows (SEQ ID NO: 325, substituted residues are bold):

```
(Signal peptide)
MKWVTFISLLFLFSSAYS (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS
```

(Human Tissue Factor 219)
SGTTNTVAAYNLTWKSTNFATALEWEPKPVNQVYTVQISTKSGDWKSKC

FYTTDTECALTDEIVKDVKQTYLARVFSYPAGNVESTGSAGEPLYENSPE

FTPYLETNLGQPTIQSFEQVGTKVNVTVEDERTLVARNNTALSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

In some cases, the leader peptide is cleaved from the intact polypeptide to generate a mature form that may be soluble or secreted.

In some embodiments, the IL-21/TF mutant/IL-15 DNA construct may be combined with an TGFβRII/IL-15RαSu DNA construct, transfected into cells using a retroviral vector as described above, and expressed as IL-21/TF mutant/IL-15 and TGFβRII/IL-15RαSu fusion proteins. The IL-15RαSu domain of the TGFβRII/IL-15RαSu fusion protein binds to the IL-15 domain of the IL-21/TF mutant/IL-15 fusion protein to create an IL-21/TF mutant/IL-15: TGFβRII/IL-15RαSu complex.

Example 31: Creation of IL-21/IL-15RαSu and TGFβRII/TF/IL-15 DNA Constructs and the Resulting Fusion Protein Complex In a non-limiting example, an IL-21/IL-15RαSu DNA construct was made by linking IL-21 directly to the IL-15RαSu subunit sequence. The nucleic acid sequence of the IL-21/IL-15RαSu construct (including signal sequence) is as follows (SEQ ID NO: 214):

(Signal sequence)
ATGAAGTGGGTGACCTTCATCAGCCTGCTGTTCCTGTTCTCCAGCGCCT

ACTCC (Human IL-21)
CAGGGCCAGGACAGGCACATGATCCGGATGAGGCAGCTCATCGACAT

CGTCGACCAGCTGAAGAACTACGTGAACGACCTGGTGCCCGAGTTTCTGC

CTGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGAT

CATCAACGTGAGCATCAAGAAGCTGAAGCGGAAGCCTCCCTCCACAAACG

CCGGCAGGAGGCAGAAGCACAGGCTGACCTGCCCCAGCTGTGACTCCTAC

GAGAAGAAGCCCCCCAAGGAGTTCCTGGAGAGGTTCAAGTCCCTGCTGCA

GAAGATGATCCATCAGCACCTGTCCTCCAGGACCCACGGCTCCGAGGACT

CC (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG

The amino acid sequence of the IL-21/IL-15RαSu construct (including signal peptide sequence) is as follows (SEQ ID NO: 213):

(Signal peptide)
MKWVTFISLLFLFSSAYS (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS (Human IL-15R α sushi domain)
ITCPPPMSVEHADIWVKSYSLYSRERYICNSGFKRKAGTSSLTECVLNKA

TNVAHWTTPSLKCIR

In some cases, the leader peptide is cleaved from the intact polypeptide to generate a mature form that may be soluble or secreted.

In some embodiments, the IL-21/IL-15RαSu DNA construct may be combined with a TGFβRII/TF/IL-15 DNA construct, transfected into a retroviral vector as described above, and expressed as IL-21/IL-15RαSu and TGFβRII/TF/IL-15 fusion proteins. The IL-15RαSu domain of the IL-21/IL-15RαSu fusion protein binds to the IL-15 domain of the TGFβRII/TF/IL-15 fusion protein to create a TGFβRII/TF/IL-15:IL-21/IL-15RαSu complex.

The TGFβRII/TF/IL-15RαSu DNA construct was created by linking the TGFβRII sequence to the N-terminus coding region of human tissue factor 219 form, and then linking the TGFβRII/TF construct to the N-terminus coding region of IL-15. As described above, a single-chain version of TGFβRII (TGFβRII-linker-TGFβRII) was used. The nucleic acid sequence of the TGFβRII/TF/IL-15 construct (including leader sequence) is as follows (SEQ ID NO: 239):

(Signal peptide)
ATGAAGTGGGTGACCTTCATCAGCCTGCTGTTCCTGTTCTCCAGCGCCT

ACTCC (Human TGF βRII-1st fragment)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCACGA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG

CAACCCTGAT (Linker)
GGAGGTGGCGGATCCGGAGGTGGAGGTTCTGGTGGAGGTGGGAGT (Human TGF βRII-2nd fragment)
ATTCCTCCCCACGTGCAGAAGAGCGTGAATAATGACATGATCGTGACC

GATAACAATGGCGCCGTGAAATTTCCCCAGCTGTGCAAATTCTGCGATGT

GAGGTTTTCCACCTGCGACAACCAGAAGTCCTGTATGAGCAACTGCACAA

TCACCTCCATCTGTGAGAAGCCTCAGGAGGTGTGCGTGGCTGTCTGGCGG

-continued

```
AAGAATGACGAGAATATCACCCTGGAAACCGTCTGCCACGATCCCAAGCT

GCCCTACCACGATTTCATCCTGGAAGACGCCGCCAGCCCTAAGTGCATCA

TGAAAGAGAAAAAGAAGCCTGGCGAGACCTTTTTCATGTGCTCCTGCAGC

AGCGACGAATGCAACGACAATATCATCTTTAGCGAGGAATACAATACCAG

CAACCCCGAC
```

(Human Tissue Factor 219)
```
TCCGGCACCACCAATACCGTGGCCGCTTATAACCTCACATGGAAGAGC

ACCAACTTCAAGACAATTCTGGAATGGGAACCCAAGCCCGTCAATCAAGT

TTACACCGTGCAGATCTCCACCAAATCCGGAGACTGGAAGAGCAAGTGCT

TCTACACAACAGACACCGAGTGTGATTTAACCGACGAAATCGTCAAGGAC

GTCAAGCAAACCTATCTGGCTCGGGTCTTTTCCTACCCCGCTGGCAATGT

CGAGTCCACCGGCTCCGCTGGCGAGCCTCTCTACGAATTCCCCCGAAT

TCACCCCTTATTTAGAGACCAATTTAGGCCAGCCTACCATCCAGAGCTTC

GAGCAAGTTGGCACCAAGGTGAACGTCACCGTCGAGGATGAAAGGACTTT

AGTGCGGCGGAATAACACATTTTTATCCCTCCGGGATGTGTTCGGCAAAG

ACCTCATCTACACACTGTACTATTGGAAGTCCAGCTCCTCCGGCAAAAAG

ACCGCTAAGACCAACACCAACGAGTTTTTAATTGACGTGGACAAAGGCGA

GAACTACTGCTTCAGCGTGCAAGCCGTGATCCCTTCTCGTACCGTCAACC

GGAAGAGCACAGATTCCCCCGTTGAGTGCATGGGCCAAGAAAAGGGCGAG

TTCCGGGAG
```

(Human IL-15)
```
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC
```

The amino acid sequence of the TGFβRII/TF/IL-15 fusion protein (including signal peptide) is as follows (SEQ ID NO: 238):

(Signal peptide)
MKWVTFISLLFLFSSAYS (Human TGF βRII-1st fragment)
IPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKC

IMKEKKKPGETFFMCSCSSDECNDNIIFSEEYNTSNPD (Linker)
GGGGSGGGGSGGGGS (Human TGF βRII-2nd fragment)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPD (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

Example 32. Production of an Exemplary Single-Chain Chimeric Polypeptides

Figure 57:
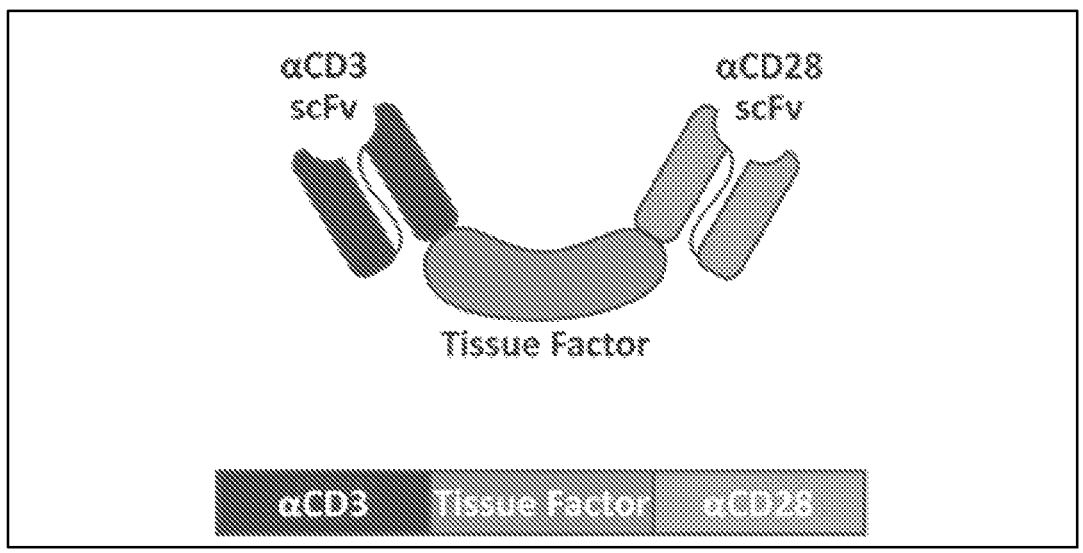
FIG. 57 are schematic diagrams of an exemplary αCD3scFv/TF/αCD28scFv single-chain chimeric polypeptide.

An exemplary single-chain chimeric polypeptide including a first target-binding domain that is an anti-CD3 scFv, a soluble human tissue factor domain, and a second target-binding domain that is an anti-CD28 scFv was generated (αCD3scFv/TF/αCD28scFv) (FIG. 57). The nucleic acid and amino acid sequences of this single-chain chimeric polypeptide are shown below.

Nucleic Acid Encoding Exemplary Single-Chain Chimeric Polypeptide (αCD3scFv/TF/αCD28scFv) (SEQ ID NO: 158)

(Signal peptide)
```
ATGAAGTGGGTGACCTTCATCAGCTTATTATTTTTATTCAGCTCCGCCT

ATTCC
```

(αCD3 light chain variable region)
```
CAGATCGTGCTGACCCAAAGCCCCGCCATCATGAGCGCTAGCCCCGGT

GAGAAGGTGACCATGACATGCTCCGCTTCCAGCTCCGTGTCCTACATGAA

CTGGTATCAGCAGAAAAGCGGAACCAGCCCCAAAAGGTGGATCTACGACA

CCAGCAAGCTGGCCTCCGGAGTGCCCGCTCATTTCCGGGGCTCTGGATCC

GGCACCAGCTACTCTTTAACCATTTCCGGCATGGAAGCTGAAGACGCTGC

CACCTACTATTGCCAGCAATGGAGCAGCAACCCCTTCACATTCGGATCTG

GCACCAAGCTCGAAATCAATCGT
```

(Linker)
```
GGAGGAGGTGGCAGCGGCGGCGGTGGATCCGGCGGAGGAGGAAGC
```

(αCD3 heavy chain variable region)
```
CAAGTTCAACTCCAGCAGAGCGGCGCTGAACTGGCCCGGCCCGGCGC

CTCCGTCAAGATGAGCTGCAAGGCTTCCGGCTATACATTTACTCGTTACA

CAATGCATTGGGTCAAGCAGAGGCCCGGTCAAGGTTTAGAGTGGATCGGA

TATATCAACCCTTCCCGGGGCTACACCAACTATAACCAAAAGTTCAAGGA

TAAAGCCACTTTAACCACTGACAAGAGCTCCTCCACCGCCTACATGCAGC

TGTCCTCTTTAACCAGCGAGGACTCCGCTGTTTACTACTGCGCTAGGTAT

TACGACGACCACTACTGTTTAGACTATTGGGGACAAGGTACCACTTTAAC

CGTCAGCAGC
```

(Human tissue factor 219 form)
TCCGGCACCACCAATACCGTGGCCGCTTATAACCTCACATGGAAGAGC

ACCAACTTCAAGACAATTCTGGAATGGGAACCCAAGCCCGTCAATCAAGT

TTACACCGTGCAGATCTCCACCAAATCCGGAGACTGGAAGAGCAAGTGCT

TCTACACAACAGACACCGAGTGTGATTTAACCGACGAAATCGTCAAGGAC

GTCAAGCAAACCTATCTGGCTCGGGTCTTTTCCTACCCCGCTGGCAATGT

CGAGTCCACCGGCTCCGCTGGCGAGCCTCTCTACGAGAATTCCCCCGAAT

TCACCCCTTATTTAGAGACCAATTTAGGCCAGCCTACCATCCAGAGCTTC

GAGCAAGTTGGCACCAAGGTGAACGTCACCGTCGAGGATGAAAGGACTTT

AGTGCGGCGGAATAACACATTTTTATCCCTCCGGGATGTGTTCGGCAAAG

ACCTCATCTACACACTGTACTATTGGAAGTCCAGCTCCTCCGGCAAAAAG

ACCGCTAAGACCAACACCAACGAGTTTTTAATTGACGTGGACAAAGGCGA

GAACTACTGCTTCAGCGTGCAAGCCGTGATCCCTTCTCGTACCGTCAACC

GGAAGAGCACAGATTCCCCCGTTGAGTGCATGGGCCAAGAAAAGGGCGAG

TTCCGGGAG (αCD28 light chain variable region)
GTCCAGCTGCAGAGAGCGGACCCGAACTCGTGAAACCCGGTGCTTCC

GTGAAAATGTCTTGTAAGGCCAGCGGATACACCTTCACCTCCTATGTGAT

CCAGTGGGTCAAACAGAAGCCCGGACAAGGTCTCGAGTGGATCGGCAGCA

TCAACCCTTACAACGACTATACCAAATACAACGAGAAGTTTAAGGGAAAG

GCTACTTTAACCTCCGACAAAAGCTCCATCACAGCCTACATGGAGTTCAG

CTCTTTAACATCCGAGGACAGCGCTCTGTACTATTGCGCCCGGTGGGGCG

ACGGCAATTACTGGGGACGGGGCACAACACTGACCGTGAGCAGC (Linker)
GGAGGCGGAGGCTCCGGCGGAGGCGGATCTGGCGGTGGCGGCTCC (αCD28 light chain variable region)
GACATCGAGATGACCCAGTCCCCCGCTATCATGTCCGCCTCTTTAGGCGA

GCGGGTCACAATGACTTGTACAGCCTCCTCCAGCGTCTCCTCCTCCTACT

TCCATTGGTACCAACAGAAACCCGGAAGCTCCCCTAAACTGTGCATCTAC

AGCACCAGCAATCTCGCCAGCGGCGTGCCCCCTAGGTTTTCCGGAAGCGG

AAGCACCAGCTACTCTTTAACCATCTCCTCCATGGAGGCTGAGGATGCCG

CCACCTACTTTTGTCACCAGTACCACCGGTCCCCCACCTTCGGAGGCGGC

ACCAAACTGGAGACAAAGAGG

Exemplary Single-Chain Chimeric Polypeptide (αCD3scFv/
TF/αCD28scFv) (SEQ ID NO: 157)

(Signal peptide)
MKWVTFISLLFLFSSAYS (αCD3 light chain variable region)
QIVLTQSPAIMSASPGEKVTMTCSASSSVSYMNWYQQKSGTSPKRWIYDT

SKLASGVPAHFRGSGSGTSYSLTISGMEAEDAATYYCQQWSSNPFTFGSG

TKLEINR (Linker)
GGGGSGGGGSGGGGS (αCD3 heavy chain variable region)
QVQLQQSGAELARPGASVKMSCKASGYTFTRYTMHWVKQRPGQGLEWI

GYINPSRGYTNYNQKFKDKATLTTDKSSSTAYMQLSSLTSEDSAVYYCAR

YYDDHYCLDYWGQGTTLTVSS (Human tissue factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (αCD28 light chain variable region)
VQLQQSGPELVKPGASVKMSCKASGYTFTSYVIQWVKQKPGQGLEWIGS

INPYNDYTKYNEKFKGKATLTSDKSSITAYMEFSSLTSEDSALYYCARWG

DGNYWGRGTTLTVSS (Linker)
GGGGSGGGGSGGGGS (αCD28 heavy chain variable region)
DIEMTQSPAIMSASLGERVTMTCTASSSVSSSYFHWYQQKPGSSPKLCIY

STSNLASGVPPRFSGSGSTSYSLTISSMEAEDAATYFCHQYHRSPTFGGG

TKLETKR

A second exemplary single-chain chimeric polypeptide including a first target-binding domain that is an anti-CD28 scFv, a soluble human tissue factor domain, and a second target-binding domain that is an anti-CD3 scFv was generated (αCD28scFv/TF/αCD3scFv) (FIG. 57). The nucleic acid and amino acid sequences of this single-chain chimeric polypeptide are shown below.

Nucleic Acid Encoding Exemplary Single-Chain Chimeric Polypeptide (αCD28scFv/TF/αCD3scFv) (SEQ ID NO: 326)

(Signal peptide)
ATGAAATGGGTCACCTTCATCTCTTTACTGTTTTTATTTAGCAGCGCCT

ACAGC (αCD28 light chain variable region)
GTGCAGCTGCAGCAGTCCGGACCCGAACTGGTCAAGCCCGGTGCCTCC

GTGAAAATGTCTTGTAAGGCTTCTGGCTACACCTTTACCTCCTACGTCAT

CCAATGGGTGAAGCAGAAGCCCGGTCAAGGTCTCGAGTGGATCGGCAGCA

TCAATCCCTACAACGATTACACCAAGTATAACGAAAAGTTTAAGGGCAAG

GCCACTCTGACAAGCGACAAGAGCTCCATTACCGCCTACATGGAGTTTTC

CTCTTTAACTTCTGAGGACTCCGCTTTATACTATTGCGCTCGTTGGGGCG

ATGGCAATTATTGGGGCCGGGGAACTACTTTAACAGTGAGCTCC (Linker)
GGCGGCGGCGGAAGCGGAGGTGGAGGATCTGGCGGTGGAGGCAGC (αCD28 heavy chain variable region)
GACATCGAGATGACACAGTCCCCCGCTATCATGAGCGCCTCTTTAGGA

GAACGTGTGACCATGACTTGTACAGCTTCCTCCAGCGTGAGCAGCTCCTA

-continued

```
TTTCCACTGGTACCAGCAGAAACCCGGCTCCTCCCCTAAACTGTGTATCT

ACTCCACAAGCAATTTAGCTAGCGGCGTGCCTCCTCGTTTTAGCGGCTCC

GGCAGCACCTCTTACTCTTTAACCATTAGCTCTATGGAGGCCGAAGATGC

CGCCACATACTTTTGCCATCAGTACCACCGGTCCCCTACCTTTGGCGGAG

GCACAAAGCTGGAGACCAAGCGG
```

(Human tissue factor 219 form)
```
AGCGGCACCACCAACACAGTGGCCGCCTACAATCTGACTTGGAAATCC

ACCAACTTCAAGACCATCCTCGAGTGGGAGCCCAAGCCCGTTAATCAAGT

TTATACCGTGCAGATTTCCACCAAGAGCGGCGACTGGAAATCCAAGTGCT

TCTATACCACAGACACCGAGTGCGATCTCACCGACGAGATCGTCAAAGAC

GTGAAGCAGACATATTTAGCTAGGGTGTTCTCCTACCCCGCTGGAAACGT

GGAGAGCACCGGATCCGCTGGAGAGCCTTTATACGAGAACTCCCCCGAAT

TCACCCCCTATCTGGAAACCAATTTAGGCCAGCCCACCATCCAGAGCTTC

GAACAAGTTGGCACAAAGGTGAACGTCACCGTCGAAGATGAGAGGACTTT

AGTGCGGAGGAACAATACATTTTTATCCTTACGTGACGTCTTCGGCAAGG

ATTTAATCTACACACTGTATTACTGGAAGTCTAGCTCCTCCGGCAAGAAG

ACCGCCAAGACCAATACCAACGAATTTTTAATTGACGTGGACAAGGGCGA

GAACTACTGCTTCTCCGTGCAAGCTGTGATCCCCTCCCGGACAGTGAACC

GGAAGTCCACCGACTCCCCCGTGGAGTGCATGGGCCAAGAGAAGGGAGAG

TTTCGTGAG
```

(αCD3 light chain variable region)
```
CAGATCGTGCTGACCCAGTCCCCCGCTATTATGAGCGCTAGCCCCGGT

GAAAAGGTGACTATGACATGCAGCGCCAGCTCTTCCGTGAGCTACATGAA

CTGGTATCAGCAGAAGTCCGGCACCAGCCCTAAAAGGTGGATCTACGACA

CCAGCAAGCTGGCCAGCGGCGTCCCCGCTCACTTTCGGGGCTCCGGCTCC

GGAACAAGCTACTCTCTGACCATCAGCGGCATGGAAGCCGAGGATGCCGC

TACCTATTACTGTCAGCAGTGGAGCTCCAACCCCTTCACCTTTGGATCCG

GCACCAAGCTCGAGATTAATCGT
```

(Linker)
```
GGAGGCGGAGGTAGCGGAGGAGGCGGATCCGGCGGTGGAGGTAGC
```

(αCD3 heavy chain variable region)
```
CAAGTTCAGCTCCAGCAAAGCGGCGCCGAACTCGCTCGGCCCGGCGCT

TCCGTGAAGATGTCTTGTAAGGCCTCCGGCTATACCTTCACCCGGTACAC

AATGCACTGGGTCAAGCAACGGCCCGGTCAAGGTTTAGAGTGGATTGGCT

ATATCAACCCCTCCCGGGGCTATACCAACTACAACCAGAAGTTCAAGGAC

AAAGCCACCCTCACCACCGACAAGTCCAGCAGCACCGCTTACATGCAGCT

GAGCTCTTTAACATCCGAGGATTCCGCCGTGTACTACTGCGCTCGGTACT

ACGACGATCATTACTGCCTCGATTACTGGGGCCAAGGTACCACCTTAACA

GTCTCCTCC
```

Exemplary Single-Chain Chimeric Polypeptide (αCD28scFv/TF/αCD3scFv) (SEQ ID NO: 327)

(Signal peptide)
MKWVTFISLLFLFSSAYS (αCD28 light chain variable region)
VQLQQSGPELVKPGASVKMSCKASGYTFTSYVIQWVKQPGQGLEWIGS

INPYNDYTKYNEKFKGKATLTSDKSSITAYMEFSSLTSEDSALYYCARWG

DGNYWGRGTTLTVSS (Linker)
GGGGSGGGGSGGGGS (αCD28 heavy chain variable region)
DIEMTQSPAIMSASLGERVTMTCTASSSVSSSYFHWYQQKPGSSPKLCIY

STSNLASGVPPRFSGSGSTSYSLTISSMEAEDAATYFCHQYHRSPTFGGG

TKLETKR (Human tissue factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (αCD3 light chain variable region)
QIVLTQSPAIMSASPGEKVTMTCSASSSVSYMNWYQQKSGTSPKRWIYDT

SKLASGVPAHFRGSGSGTSYSLTISGMEAEDAATYYCQQWSSNPFTFGSG

TKLEINR (Linker)
GGGGSGGGGSGGGGS (αCD3 heavy chain variable region)
QVQLQQSGAELARPGASVKMSCKASGYTFTRYTMHWVKQRPGQGLEWI

GYINPSRGYTNYNQKFKDKATLTTDKSSSTAYMQLSSLTSEDSAVYYCAR

YYDDHYCLDYWGQGTTLTVSS

The nucleic acid encoding αCD3scFv/TF/αCD28scFv was cloned into a modified retrovirus expression vectors as described previously (Hughes et al., *Hum Gene Ther* 16:457-72, 2005). The expression vector encoding αCD3scFv/TF/αCD28scFv was transfected into CHO-K1 cells. Expression of the expression vector in CHO-K1 cells allowed for secretion of the soluble αCD3scFv/TF/αCD28scFv single-chain chimeric polypeptide (referred to as 3t28), which can be purified by anti-TF Ab affinity and other chromatography methods.

An anti-tissue factor affinity column was used to purify the αCD3scFv/TF/αCD28scFv single-chain chimeric polypeptide. The anti-tissue factor affinity column was connected to a GE Healthcare AKTA Avant system. A flow rate of 4 mL/min was used for all steps except the elution step, which was 2 mL/min.

Figure 58:
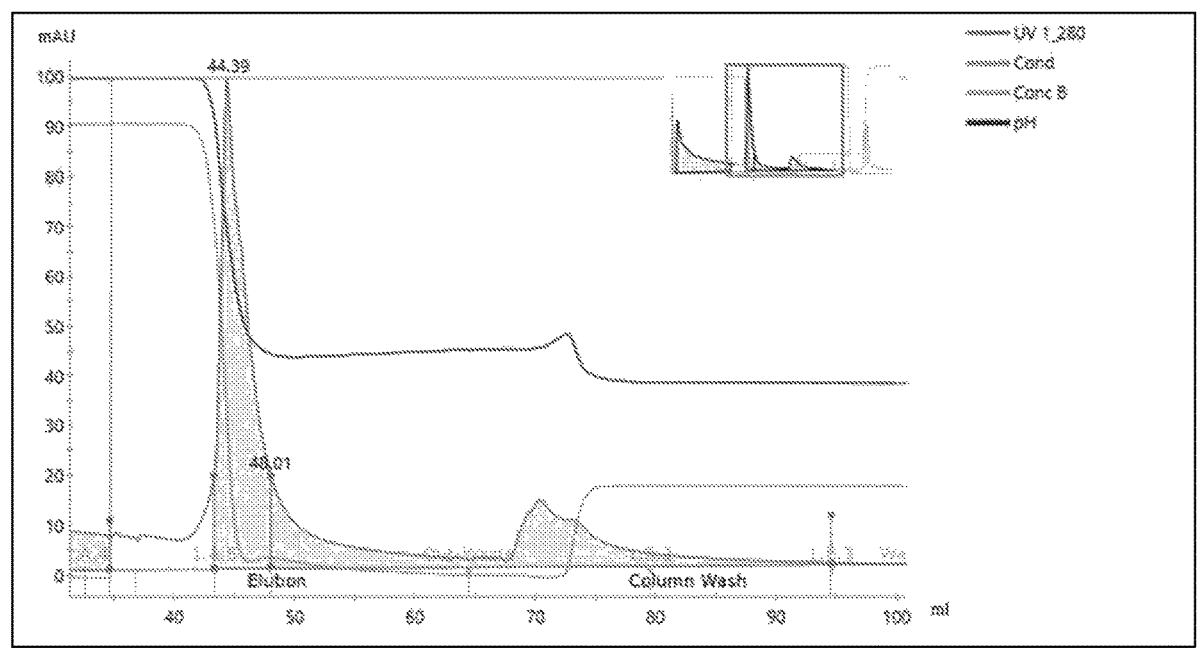
FIG. 58 is a chromatograph showing the elution of an exemplary αCD3scFv/TF/αCD28scFv single-chain chimeric polypeptide from an anti-tissue factor affinity column.

Cell culture harvest including αCD3scFv/TF/αCD28scFv single-chain chimeric polypeptide was adjusted to pH 7.4 with 1M Tris base and loaded onto the anti-TF antibody affinity column (described above) which was equilibrated with 5 column volumes of PBS. After sample loading, the column was washed with 5 column volumes PBS, followed by elution with 6 column volumes 0.1 M acetic acid, pH 2.9. An A280 elution peak was collected and then neutralized to pH 7.5-8.0 by adding 1 M Tris base. The neutralized sample was then buffer exchanged into PBS using Amicon centrifugal filters with a 30 kDa molecular weight cutoff. The data in FIG. 58 show that the anti-tissue factor affinity column can bind the αCD3scFv/TF/αCD28scFv single-chain chimeric polypeptide, which contains a human soluble tissue factor domain. The buffer-exchanged protein sample was stored at 2-8° C. for further biochemical analysis and biological activity testing.

After each elution, the anti-tissue factor affinity column was stripped using 6 column volumes of 0.1 M glycine, pH 2.5. The column was then neutralized using 10 column volumes of PBS, 0.05% $NaN_3$, and stored at 2-8° C.

Figure 59:
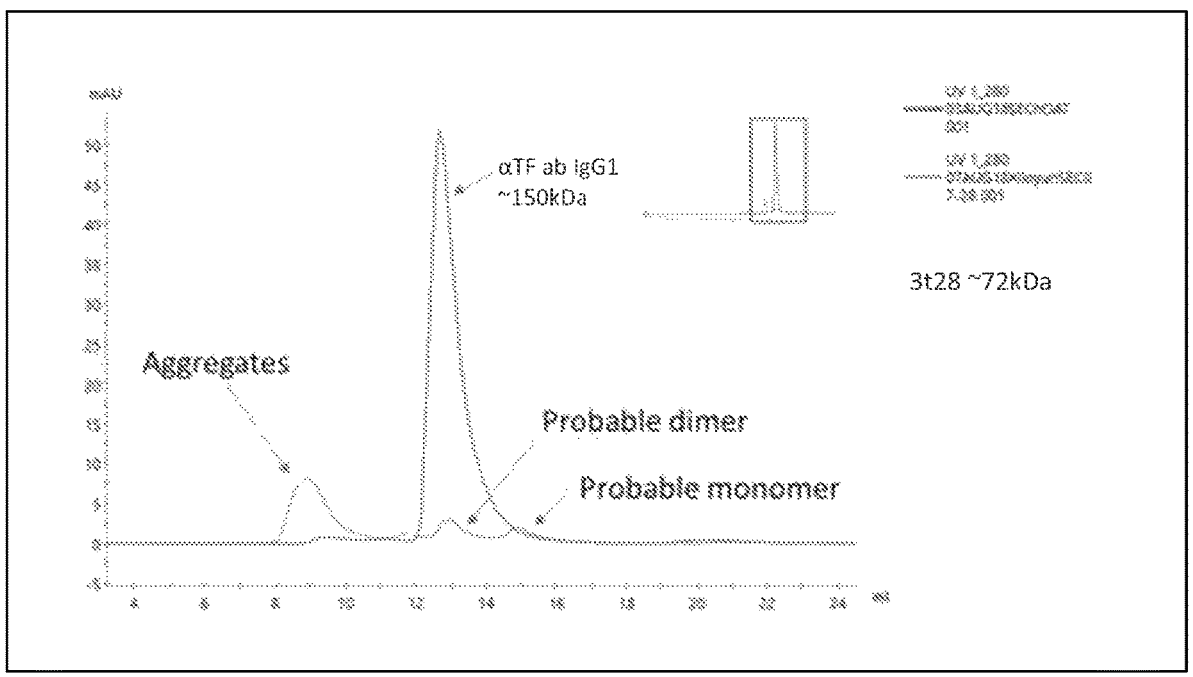
FIG. 59 is a chromatograph showing the elution of a Superdex 200 Increase 10/300 GL gel filtration column loaded with an exemplary αCD3scFv/TF/αCD28scFv single-chain chimeric polypeptide.

Analytical size exclusion chromatography (SEC) was performed on the αCD3scFv/TF/αCD28scFv single-chain chimeric polypeptide using a Superdex 200 Increase 10/300 GL gel filtration column (from GE Healthcare) connected to an AKTA Avant system (from GE Healthcare). The column was equilibrated with 2 column volumes of PBS. A flow rate of 0.8 mL/min was used. Two hundred μL of αCD3scFv/TF/αCD28scFv single-chain chimeric polypeptide (1 mg/mL) was injected onto the column using a capillary loop. After injection of the single-chain chimeric polypeptide, 1.25 column volumes of PBS were flowed into the column. The SEC chromatograph is shown in FIG. 59. The data show that there are 3 protein peaks, likely representing a monomer and dimer or other different forms of the αCD3scFv/TF/αCD28scFv single-chain chimeric polypeptide.

Figure 60:
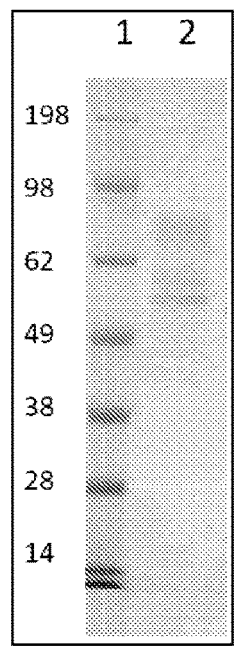
FIG. 60 is a sodium dodecyl sulfate polyacrylamide gel (4-12% NuPage Bis-Tris gel) of an exemplary αCD3scFv/TF/αCD28scFv single-chain chimeric polypeptide purified using an anti-tissue factor affinity column.

To determine the purity and protein molecular weight of the αCD3scFv/TF/αCD28scFv single-chain chimeric polypeptide, the purified αCD3scFv/TF/αCD28scFv protein sample from anti-tissue factor affinity column was analyzed by standard sodium dodecyl sulfate polyacrylamide gel (4-12% NuPage Bis-Tris gel) electrophoresis (SDS-PAGE) method under reduced conditions. The gel was stained with InstantBlue for about 30 minutes and destained overnight with purified water. FIG. 60 shows the SDS gel of the αCD3scFv/TF/αCD28scFv single-chain chimeric polypeptide purified using an anti-tissue factor affinity column. The results show that the purified αCD3scFv/TF/αCD28scFv single-chain chimeric polypeptide has the expected molecular weight (72 kDa) in reduced SDS gel.

Figure 61:
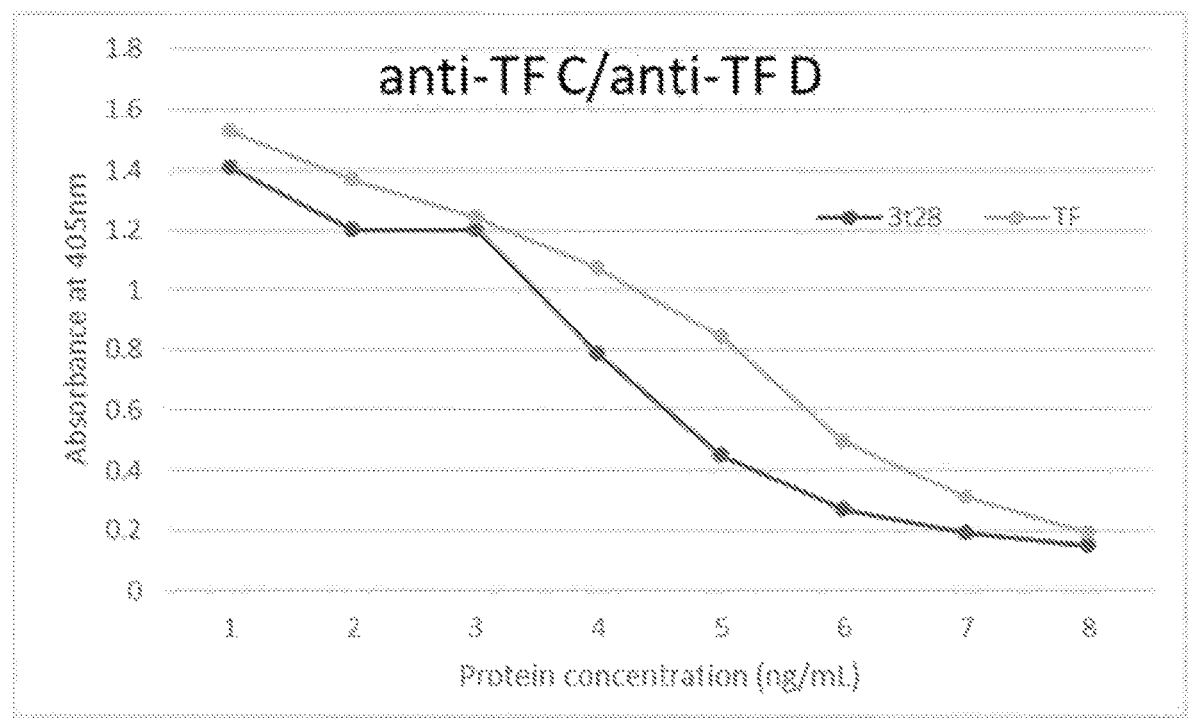
FIG. 61 is a graph showing the ELISA quantitation of an exemplary αCD3scFv/TF/αCD28scFv single-chain chimeric polypeptide performed using the methods described in Example 1. Purified tissue factor was used as the control.

Example 33. Functional Characterization of αCD3scFv/TF/αCD28scFv Single-Chain Chimeric Polypeptide ELISA-based methods confirmed the formation of the αCD3scFv/TF/αCD28scFv single-chain chimeric polypeptide. The αCD3scFv/TF/αCD28scFv single-chain chimeric polypeptide was detected using an anti-TF antibody (I43)/anti-TF antibody-specific ELISA with a capture antibody, anti-human tissue factor antibody (143), and a detection antibody, anti-TF antibody (FIG. 61). A purified tissue factor protein with a similar concentration was used as a control.

Figure 62:
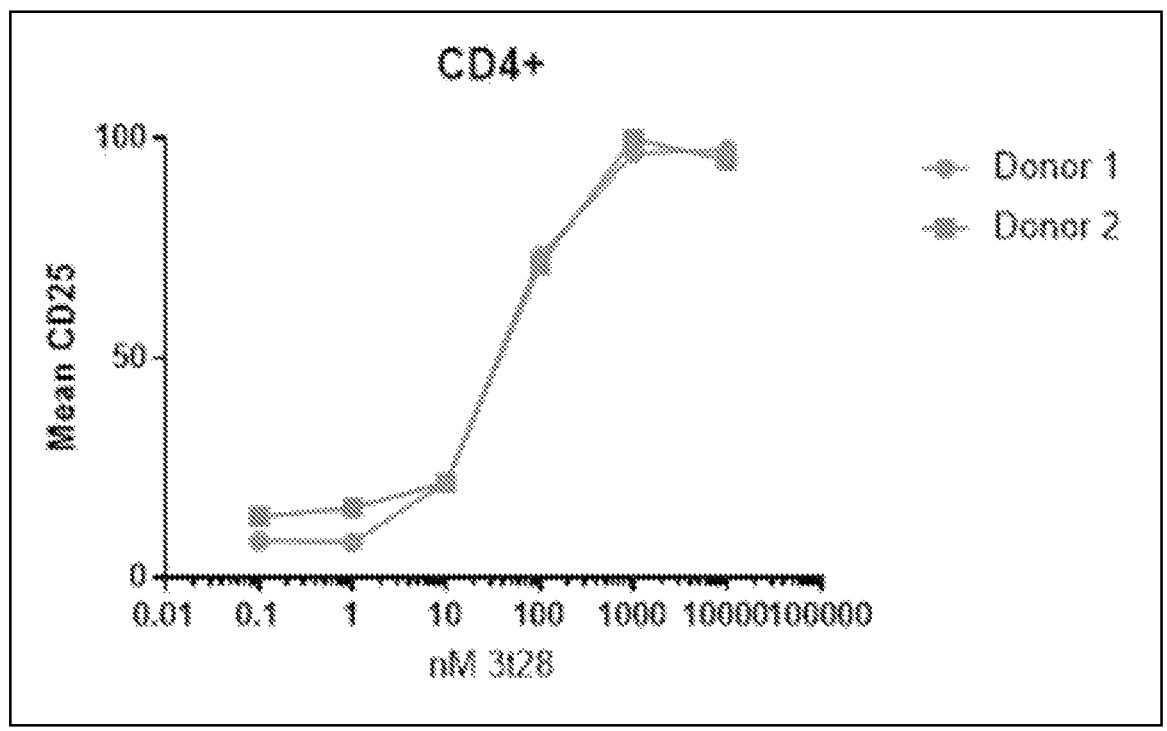
FIG. 62 is a graph showing the ability of an exemplary αCD3scFv/TF/αCD28scFv single-chain chimeric polypeptide to stimulate CD25 expression in CD4$^+$ T-cells isolated from blood from two donors. The experiments were performed as described in Example 2.
Figure 63:
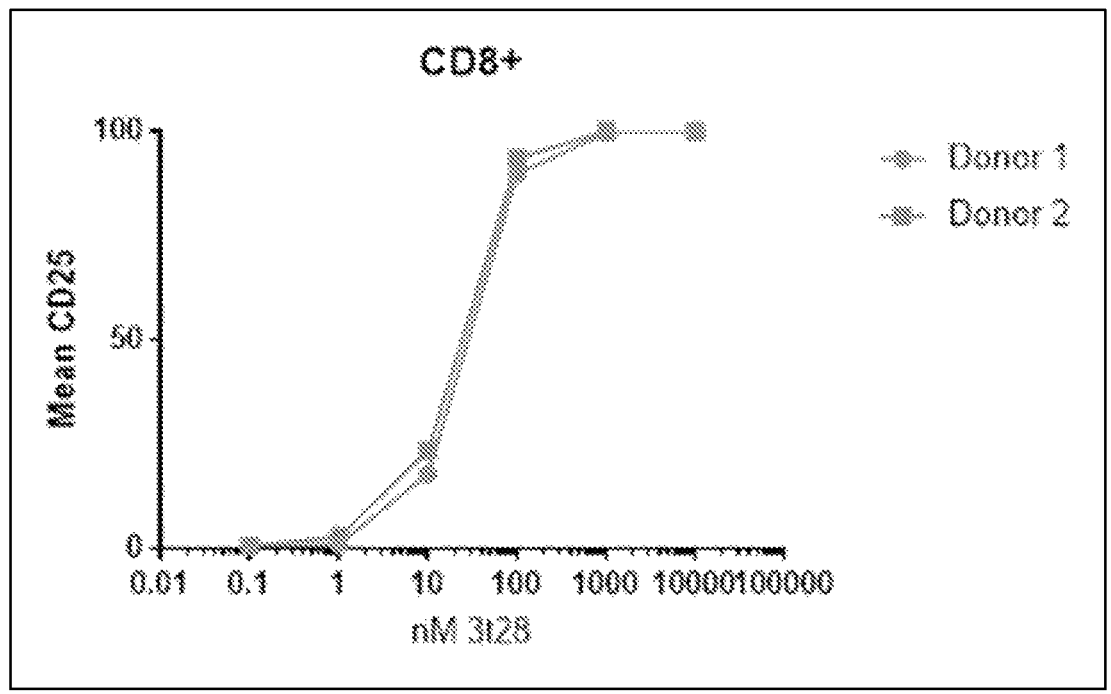
FIG. 63 is a graph showing the ability of an exemplary αCD3scFv/TF/αCD28scFv single-chain chimeric polypeptide to stimulate CD25 expression in CD8$^+$ T-cells isolated from blood from two donors. The experiments were performed as described in Example 2.
Figure 64:
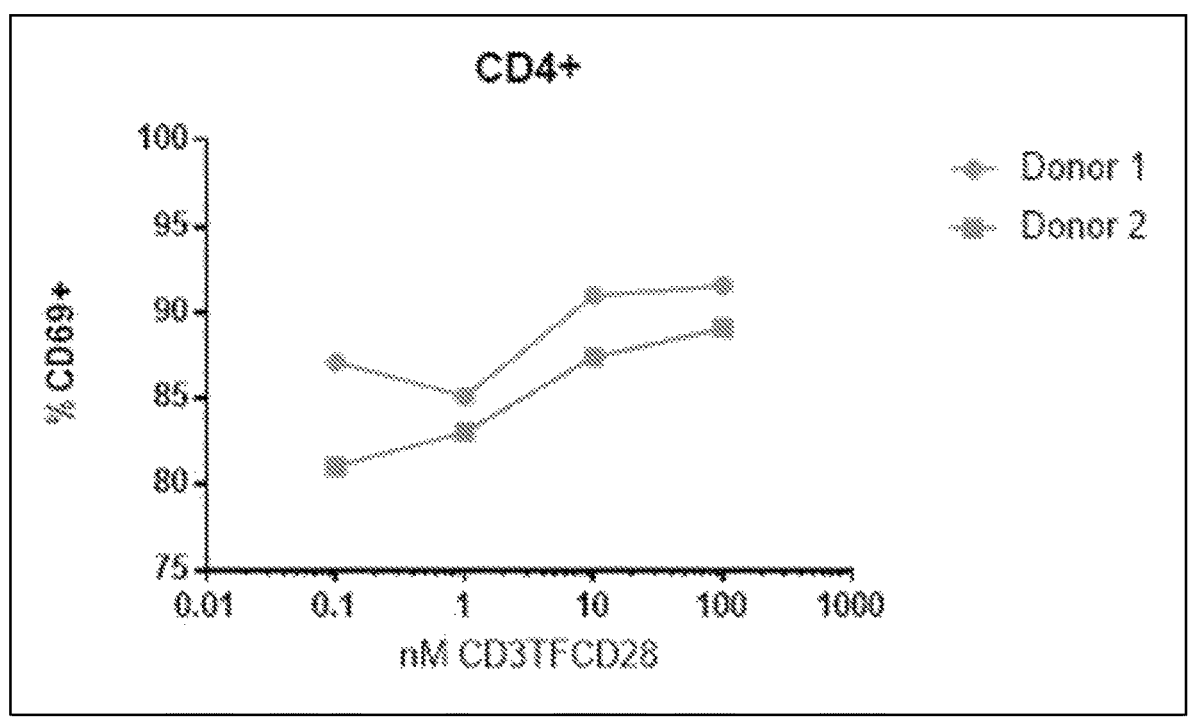
FIG. 64 is a graph showing the ability of an exemplary αCD3scFv/TF/αCD28scFv single-chain chimeric polypeptide to stimulate CD69 expression in CD4$^+$ T-cells isolated from blood from two donors. The experiments were performed as described in Example 2.

A further in vitro experiment was performed to determine whether the αCD3scFv/TF/αCD28scFv single-chain chimeric polypeptide is capable of activating human peripheral blood mononuclear cells (PBMCs). Fresh human leukocytes were obtained from the blood bank and peripheral blood mononuclear cells (PBMC) were isolated using density gradient Histopaque (Sigma). The cells were counted and resuspended in $0.2×10^6$/mL in a 96-well flat bottom plate in 0.2 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)). The cells were stimulated with αCD3scFv/TF/αCD28scFv single-chain chimeric polypeptide from 0.01 nM to 1000 nM for 3 days at 37° C., 5% $CO_2$. After 72 hours, the cells were harvested and surface stained for CD4-488, CD8-PerCP Cy5.5, CD25-BV421, CD69-APCFire750, CD62L-PE Cy7, and CD44-PE specific antibodies (Biolegend) for 30 minutes. After surface staining, the cells were washed (1500 RPM for 5 minutes at room temperature) in FACS buffer (1×PBS (Hyclone) with 0.5% BSA (EMD Millipore) and 0.001% sodium azide (Sigma)). After two washes, the cells were resuspended in 300 μL of FACS buffer and analyzed by Flow Cytometry (Celesta-BD Bioscience). The data in FIGS. 62 and 63 show that the αCD3scFv/TF/αCD28scFv single-chain chimeric polypeptide is able to stimulate both $CD8^+$ and $CD4^+$ T-cells. A further experiment was performed, in which PBMCs isolated from blood using Histopaque (Sigma) were counted and resuspended in $0.2×10^6$/mL in a 96-well flat bottom plate in 0.2 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)). The cells were then stimulated with the αCD3scFv/TF/αCD28scFv single-chain chimeric polypeptide from 0.01 nM to 1000 nM for 3 days at 37° C., 5% $CO_2$. After 72 hours, the cells were harvested and surface stained for CD4-488, CD8-PerCP Cy5.5, CD25-BV421, CD69-APCFire750, CD62L-PE Cy7, and CD44-PE (Biolegend) for 30 minutes. After surface staining, the cells were washed (1500 RPM for 5 minutes at room temperature) in FACS buffer (1×PBS (Hyclone) with 0.5% BSA (EMD Millipore) and 0.001% sodium azide (Sigma)). After two washes, the cells were resuspended in 300 μL of FACS buffer and analyzed by Flow Cytometry (Celesta-BD Bioscience). The data again show that the αCD3scFv/TF/αCD28scFv single-chain chimeric polypeptide was able to stimulate activation of CD4+ T cells (FIG. 64).

Example 34: Creation of an IL-7/IL-15RαSu DNA Construct

Figure 65:
FIG. 65 shows a schematic diagram of an exemplary IL-7/IL-15RαSu DNA construct.

In a non-limiting example, an IL-7/IL-15RαSu DNA construct was created (see FIG. 65). The human IL-7 sequence, human IL-15RαSu sequence, human IL-15 sequence, and human tissue factor 219 sequence were obtained from the UniProt website and DNA for these sequences was synthesized by Genewiz. A DNA construct was made linking the IL-7 sequence to the IL-15RαSu sequence. The final IL-7/IL-15RαSu DNA construct sequence was synthesized by Genewiz.

The nucleic acid sequence encoding the second chimeric polypeptide of IL-7/IL-15RαSu construct (including signal peptide sequence) is as follows (SEQ ID NO: 206):

```
(Signal peptide)
ATGGGAGTGAAAGTTCTTTTTGCCCTTATTTGTATTGCTGTGGCCGAGG

CC (Human IL-7)
GATTGTGATATTGAAGGTAAAGATGGCAAACAATATGAGAGTGTTCTA

ATGGTCAGCATCGATCAATTATTGGACAGCATGAAAGAAATTGGTAGCAA

TTGCCTGAATAATGAATTTAACTTTTTTAAAAGACATATCTGTGATGCTA

ATAAGGAAGGTATGTTTTTATTCCGTGCTGCTCGCAAGTTGAGGCAATTT
```

```
CTTAAAATGAATAGCACTGGTGATTTTGATCTCCACTTATTAAAAGTTTC

AGAAGGCACAACAATACTGTTGAACTGCACTGGCCAGGTTAAAGGAAGAA

AACCAGCTGCCCTGGGTGAAGCCCAACCAACAAAGAGTTTGGAAGAAAAT

AAATCTTTAAAGGAACAGAAAAAACTGAATGACTTGTGTTTCCTAAAGAG

ACTATTACAAGAGATAAAAACTTGTTGGAATAAAATTTTGATGGGCACTA

AAGAACAC (Human IL-15R α sushi domain)
ATCACGTGCCCTCCCCCCATGTCCGTGGAACACGCAGACATCTGGGTC

AAGAGCTACAGCTTGTACTCCAGGGAGCGGTACATTTGTAACTCTGGTTT

CAAGCGTAAAGCCGGCACGTCCAGCCTGACGGAGTGCGTGTTGAACAAGG

CCACGAATGTCGCCCACTGGACAACCCCCAGTCTCAAATGCATTAGA
```

The second chimeric polypeptide of IL-7/IL-15RαSu construct (including signal peptide sequence) is as follows (SEQ ID NO: 205):

```
(Signal peptide)
MKWVTFISLLFLFSSAYS (Human IL-7)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EH (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS
```

Example 35: Creation of an IL-21/TF/IL-15 DNA Construct

Figure 66:
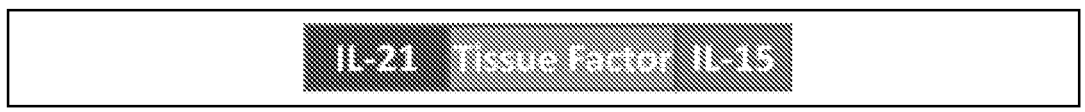
FIG. 66 shows a schematic diagram of an exemplary IL-21/TF/IL-15 DNA construct.

In a non-limiting example, an IL-21/TF/IL-15 construct was made (FIG. 66) by linking the IL-21 sequence to the N-terminus coding region of tissue factor 219, and further linking the IL-21/TF construct with the N-terminus coding region of IL-15.

The nucleic acid sequence encoding the first chimeric polypeptide of IL-21/TF/IL-15 construct (including leader sequence), synthesized by Genewiz, is as follows (SEQ ID NO: 202):

```
(Signal peptide)
ATGGGAGTGAAAGTTCTTTTTGCCCTTATTTGTATTGCTGTGGCCGAGG

CC
```

```
(Human IL-21 fragment)
CAAGGTCAAGATCGCCACATGATTAGAATGCGTCAACTTATAGATATT

GTTGATCAGCTGAAAAATTATGTGAATGACTTGGTCCCTGAATTTCTGCC

AGCTCCAGAAGATGTAGAGACAAACTGTGAGTGGTCAGCTTTTTCCTGTT

TTCAGAAGGCCCAACTAAAGTCAGCAAATACAGGAAACAATGAAAGGATA

ATCAATGTATCAATTAAAAAGCTGAAGAGGAAACCACCTTCCACAAATGC

AGGGAGAAGACAGAAACACAGACTAACATGCCCTTCATGTGATTCTTATG

AGAAAAAACCACCCAAAGAATTCCTAGAAAGATTCAAATCACTTCTCCAA

AAGATGATTCATCAGCATCTGTCCTCTAGAACACACGGAAGTGAAGATTC

C (Human Tissue Factor 219)
TCAGGCACTACAAATACTGTGGCAGCATATAATTTAACTTGGAAATCA

ACTAATTTCAAGCACAATTTTGGAGTGGGAACCCAAACCCGTCAATCAAGT

CTACACTGTTCAAATAAGCACTAAGTCAGGAGATTGGAAAAGCAAATGCT

TTTACACAACAGACACAGAGTGTGACCTCACCGACGAGATTGTGAAGGAT

GTGAAGCAGACGTACTTGGCACGGGTCTTCTCCTACCCGGCAGGGAATGT

GGAGAGCACCGGTTCTGCTGGGGAGCCTCTGTATGAGAACTCCCCAGAGT

TCACACCTTACCTGGAGACAAACCTCGGACAGCCAACAATTCAGAGTTTT

GAACAGGTGGGAACAAAAGTGAATGTGACCGTAGAAGATGAACGGACTTT

AGTCAGAAGGAACAACACTTTCCTAAGCCTCCGGGATGTTTTTGGCAAGG

ACTTAATTTATACACTTTATTATTGGAAATCTTCAAGTTCAGGAAAGAAA

ACAGCCAAAACAAACACTAATGAGTTTTTGATTGATGTGGATAAAGGAGA

AAACTACTGTTTCAGTGTTCAAGCAGTGATTCCCTCCCGAACAGTTAACC

GGAAGAGTACAGACAGCCCGGTAGAGTGTATGGGCCAGGAGAAAGGGGAA

TTCAGAGAA (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC
```

The first chimeric polypeptide of IL-21/TF/IL-15 construct including leader sequence is SEQ ID NO: 201:

```
(Signal peptide)                        (SEQ ID NO: 328)
MGVKVLFALICIAVAEA (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS
```

-continued (Human Tissue Factor 219)
SGTTNTVAAYNLTWKSTNFKTILEWEPKPVNQVYTVQISTKSGDWKSKCF

YTTDTECDLTDEIVKDVKQTYLARVFSYPAGNVESTGSAGEPLYENSPEF

TPYLETNLGQPTIQSFEQVGTKVNVTVEDERTLVRRNNTFLSLRDVFGKD

LIYTLYYWKSSSSGKKTAKTNTNEFLIDVDKGENYCFSVQAVIPSRTVNR

KSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

Example 36: Secretion of IL-7/IL-15RαSu and IL-21/TF/IL-15 Fusion Proteins

Figure 67:
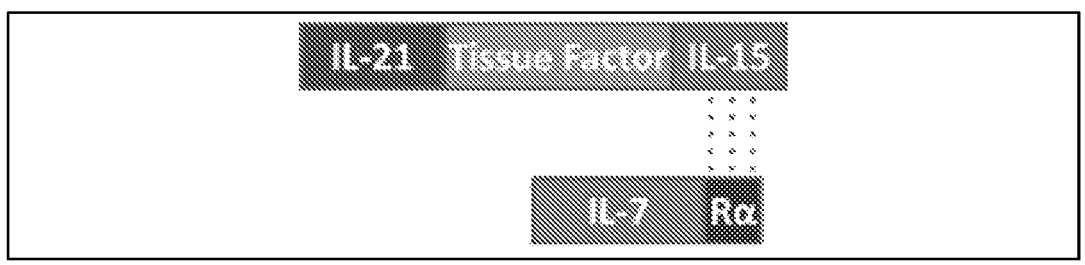
FIG. 67 shows a schematic diagram of the interaction between the exemplary IL-7/IL-15RαSu and IL-21/TF/IL-15 DNA constructs.
Figure 68:
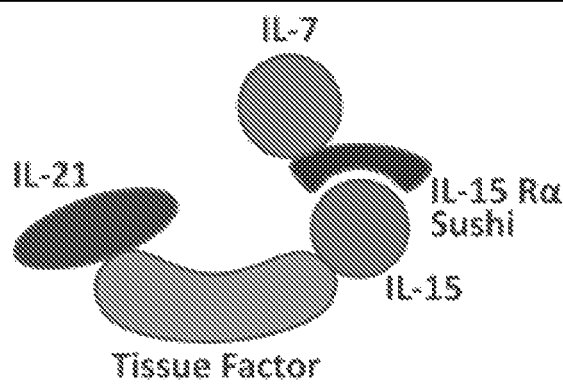
FIG. 68 shows a schematic diagram of the interaction between the exemplary IL-7/IL-15RαSu and IL-21/TF/IL-15 fusion proteins resulting in an IL-21/TF/IL-15:IL-7/IL-15RαSu complex (21t15-7s).

The IL-7/IL-15RαSu and IL-21/TF/IL-15 DNA constructs were cloned into a pMSGV-1 modified retrovirus expression vector (as described by Hughes, *Hum Gene Ther* 16:457-72, 2005, hereby incorporated by reference), and the expression vector was transfected into CHO-K1 cells. Co-expression of the two constructs in CHO-K1 cells allowed for formation and secretion of a soluble IL-21/TF/IL-15:IL-7/IL-15RαSu protein complex (referred to as 21t15-7s; FIG. 67 and FIG. 68). The 21t15-7s protein was purified from CHO-K1 cell culture supernatant using anti-TF antibody affinity chromatography and size exclusion chromatography resulting in soluble (non-aggregated) protein complexes consisting of IL-7/IL-15RαSu and IL-21/TF/IL-15 fusion proteins.

In some cases, the leader (signal sequence) peptide is cleaved from the intact polypeptide to generate the mature form that may be soluble or secreted.

Example 37: Purification of 21t15-7s by Immunoaffinity Chromatography

An anti-TF antibody affinity column was connected to a GE Healthcare™ AKTA Avant protein purification system. The flow rate was 4 mL/min for all steps except the elution step, which was 2 mL/min.

Cell culture harvest of 21t15-7s was adjusted to pH 7.4 with 1M Tris base and loaded onto the anti-TF antibody affinity column equilibrated with 5 column volumes of PBS. After loading the sample, the column was washed with 5 column volumes PBS, followed by elution with 6 column volumes 0.1M acetic acid, pH 2.9. Absorbance at 280 nm was collected and then the sample was neutralized to pH 7.5-8.0 by adding 1M Tris base. The neutralized sample was then buffer exchanged into PBS using Amicon® centrifugal filters with a 30 KDa molecular weight cutoff. The buffer-exchanged protein sample was stored at 2-8° C. for further biochemical analysis and biological activity testing.

After each elution, the anti-TF antibody affinity column was then stripped using 6 column volumes 0.1M glycine, pH 2.5. The column was then neutralized using 10 column volumes PBS, 0.05% sodium azide and stored at 2-8° C.

Example 38: Size Exclusion Chromatography

A GE Healthcare Superdex® 200 Increase 10/300 GL gel filtration column was connected to a GE Healthcare AKTA™ Avant protein purification system. The column was equilibrated with 2 column volumes of PBS. The flow rate was 0.7 mL/min. A capillary loop was used to inject 200ℓ of 1 mg/mL of 7t15-21s complex onto the column. The injection was chased with 1.25 column volumes of PBS.

Example 39: SDS-PAGE of 21t15-7s and 21t15-TGFRs

To determine the purity and protein molecular weight, the purified 21t15-7s or 21t15-TGFRs protein sample were analyzed using 4-12% NuPage Bis-Tris protein gel SDS-PAGE. The gel will be stained with InstantBlue™ for about 30 min, followed by destaining overnight in purified water.

Example 40: Glycosylation of 21t15-7s and 21t15-TGFRs in CHO-K1 Cells

Glycosylation of 21t15-7s in CHO-K1 cells or 21t15-TGFRs in CHO-K1 cells were confirmed using the Protein Deglycosylation Mix II kit (New England Biolabs), according to the manufacturer's instructions.

Example 41: Recombinant Protein Quantitation of 21t15-7s and 21t15-TGFRs Complexes The 21t15-7s complex or the 21t15-TGFRs complex were detected and quantified using standard sandwich ELISA methods. Anti-human tissue factor antibody (IgG1) served as the capture antibody and biotinylated anti-human IL-21, IL-15, or IL-7 antibody (21t15-7s) or biotinylated anti-human IL-21, IL-15, or TGF-βRII antibody (21t15-TGFRs) served as the detection antibody. Tissue factor in purified 21t15-7s or 21t15-TGFRs protein complexes was detected using an anti-human tissue factor capture antibody, and anti-human tissue factor antibody (IgG1) detection antibody. The anti-TF antibody ELISA will be compared to purified tissue factor at similar concentrations.

Example 42: Creation of an IL-21/IL-15RαSu DNA Construct

Figure 69:
FIG. 69 shows a schematic diagram of an exemplary IL-21/IL-15RαSu DNA construct.

In a non-limiting example, an IL-21/IL-15RαSu DNA construct was created. The human IL-21 sequence and human IL-15RαSu sequence were obtained from the UniProt website and DNA for these sequences was synthesized by Genewiz. A DNA construct was made linking the IL-21 sequence to the IL-15RαSu sequence. The final IL-21/IL-15RαSu DNA construct sequence was synthesized by Genewiz. See FIG. 69.

Example 43: Creation of an IL-7/TF/IL-15 DNA Construct

Figure 70:
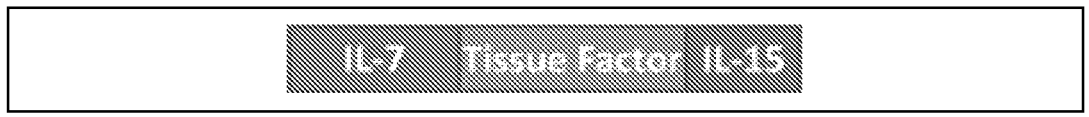
FIG. 70 shows a schematic diagram of an exemplary IL-7/TF/IL-15 DNA construct.

In a non-limiting example, an IL-7/TF/IL-15 construct was made by linking the IL-7 sequence to the N-terminus coding region of tissue factor 219, and further linking the IL-7/TF construct with the N-terminus coding region of IL-15. See FIG. 70.

Example 44: Creation of an IL-21/IL-15Rα Sushi DNA Construct

In a non-limiting example, a second chimeric polypeptide of IL-21/IL-15RαSu was generated. The human IL-21 and human IL-15Rα sushi sequences were obtained from the UniProt website and DNA for these sequences was synthesized by Genewiz. A DNA construct was made linking the IL-21 sequence to the IL-15Rα sushi sequence. The final IL-21/IL-15RαSu DNA construct sequence was synthesized by Genewiz.

The nucleic acid sequence encoding the second chimeric polypeptide of IL-21/IL-15RαSu domain (including leader sequence), synthesized by Genewiz, is as follows (SEQ ID NO: 214):

(Signal peptide)
ATGAAGTGGGTGACCTTCATCAGCCTGCTGTTCCTGTTCTCCAGCGCCTA

CTCC (Human IL-21)
CAGGGCCAGGACAGGCACATGATCCGGATGAGGCAGCTCATCGACATCGT

CGACCAGCTGAAGAACTACGTGAACGACCTGGTGCCCGAGTTTCTGCCTG

CCCCCGAGGACGTGGAGACCAACTGCGAGTGGTCCGCCTTCTCCTGCTTT

CAGAAGGCCCAGCTGAAGTCCGCCAACACCGGCAACAACGAGCGGATCAT

CAACGTGAGCATCAAGAAGCTGAAGCGGAAGCCTCCCTCCACAAACGCCG

GCAGGAGGCAGAAGCACAGGCTGACCTGCCCCAGCTGTGACTCCTACGAG

AAGAAGCCCCCAAGGAGTTCCTGGAGAGGTTCAAGTCCCTGCTGCAGAA

GATGATCCATCAGCACCTGTCCTCCAGGACCCACGGCTCCGAGGACTCC (Human IL-15R α sushi domain)
ATTACATGCCCCCCTCCCATGAGCGTGGAGCACGCCGACATCTGGGTGAA

GAGCTATAGCCTCTACAGCCGGGAGAGGTATATCTGTAACAGCGGCTTCA

AGAGGAAGGCCGGCACCAGCAGCCTCACCGAGTGCGTGCTGAATAAGGCT

ACCAACGTGGCTCACTGGACAACACCCTCTTTAAAGTGCATCCGG

The second chimeric polypeptide of IL-21/IL-15Rα sushi domain (including leader sequence) is as follows (SEQ ID NO: 213):

(Signal Sequence)
MKWVTFISLLFLFSSAYS (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS (Human IL-15Rα sushi domain)
ITCPPPMSVEHADIWVKSYSLYSRERYICNSGFKRKAGTSSLTECVLNKA

TNVAHWTTPSLKCIR

Example 45: Creation of an IL-7/TF/IL-15 DNA Construct

In a non-limiting example, an exemplary first chimeric polypeptide of IL-7/TF/IL-15 was made by linking the IL-7 sequence to the N-terminus coding region of tissue factor 219, and further linking the IL-7/TF construct with the N-terminus coding region of IL-15. The nucleic acid sequence encoding the first chimeric polypeptide of IL-7/TF/IL-15 (including leader sequence), synthesized by Genewiz, is as follows (SEQ ID NO: 210):

(Signal peptide)
ATGAAGTGGGTGACCTTCATCAGCCTGCTGTTCCTGTTCTCCAGCGCCTA

CTCC (Human IL-7 fragment)
GATTGCGACATCGAGGGCAAGGACGGCAAGCAGTACGAGAGCGTGCTGAT

GGTGTCCATCGACCAGCTGCTGGACAGCATGAAGGAGATCGGCTCCAACT

GCCTCAACAACGAGTTCAACTTCTTCAAGCGGCACATCTGCGACGCCAAC

AAGGAGGGCATGTTCCTGTTCAGGGCCGCCAGGAAACTGCGGCAGTTCCT

GAAGATGAACTCCACCGGCGACTTCGACCTGCACCTGCTGAAGGTGTCCG

AGGGCACCACCATCCTGCTGAACTGCACCGGACAGGTGAAGGGCCGGAAA

CCTGCTGCTCTGGGAGAGGCCCAACCCACCAAGAGCCTGGAGGAGAACAA

GTCCCTGAAGGAGCAGAAGAAGCTGAACGACCTGTGCTTCCTGAAGAGGC

TGCTGCAGGAGATCAAGACCTGCTGGAACAAGATCCTGATGGGCACCAAG

GAGCAT (Human Tissue Factor 219)
AGCGGCACAACCAACACAGTCGCTGCCTATAACCTCACTTGGAAGAGCAC

CAACTTCAAAACCATCCTCGAATGGGAACCCAAACCCGTTAACCAAGTTT

ACACCGTGCAGATCAGCACCAAGTCCGGCGACTGGAAGTCCAAATGTTTC

TATACCACCGACACCGAGTGCGATCTCACCGATGAGATCGTGAAAGATGT

GAAACAGACCTACCTCGCCCGGGTGTTTAGCTACCCCGCCGGCAATGTGG

AGAGCACTGGTTCCGCTGGCGAGCCTTTATACGAGAACAGCCCCGAATTT

ACCCCTTACCTCGAGACCAATTTAGGACAGCCCACCATCCAAAGCTTTGA

GCAAGTTGGCACAAAGGTGAATGTGACAGTGGAGGACGAGCGGACTTTAG

TGCGGCGGAACAACACCTTTCTCAGCCTCCGGGATGTGTTCGGCAAAGAT

TTAATCTACACACTGTATTACTGGAAGTCCTCTTCCTCCGGCAAGAAGAC

AGCTAAAACCAACACAAACGAGTTTTTAATCGACGTGGATAAAGGCGAAA

ACTACTGTTTCAGCGTGCAAGCTGTGATCCCCTCCCGGACCGTGAATAGG

AAAAGCACCGATAGCCCCGTTGAGTGCATGGGCCAAGAAAAGGGCGAGTT

CCGGGAG (Human IL-15)
AACTGGGTGAACGTCATCAGCGATTTAAAGAAGATCGAAGATTTAATTCA

GTCCATGCATATCGACGCCACTTTATACACAGAATCCGACGTGCACCCCT

CTTGTAAGGTGACCGCCATGAAATGTTTTTTACTGGAGCTGCAAGTTATC

TCTTTAGAGAGCGGAGACGCTAGCATCCACGACACCGTGGAGAATTTAAT

CATTTTAGCCAATAACTCTTTATCCAGCAACGGCAACGTGACAGAGTCCG

GCTGCAAGGAGTGCGAAGAGCTGGAGGAGAAGAACATCAAGGAGTTTCTG

CAATCCTTTGTGCACATTGTCCAGATGTTCATCAATACCTCC

The first chimeric polypeptide of IL-7/TF/IL-15 (including leader sequence), is as follows (SEQ ID NO: 209):

(Signal peptide)
MKWVTFISLLFLFSSAYS (Human IL-7)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

-continued

PAALGEAQPTKSLEENKSLKEQKKLNDLCFLKRLLQEIKTCWNKILMGTK

EH (Human Tissue Factor 219)
SGTTNTVAAYNLTWKSTNFKTILEWEPKPVNQVYTVQISTKSGDWKSKCF

YTTDTECDLTDEIVKDVKQTYLARVFSYPAGNVESTGSAGEPLYENSPEF

TPYLETNLGQPTIQSFEQVGTKVNVTVEDERTLVRRNNTFLSLRDVFGKD

LIYTLYYWKSSSSGKKTAKTNTNEFLIDVDKGENYCFSVQAVIPSRTVNR

KSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

Example 46: Secretion of IL-21/IL-15RαSu and IL-7/TF/IL-15 Fusion Proteins

Figure 71:
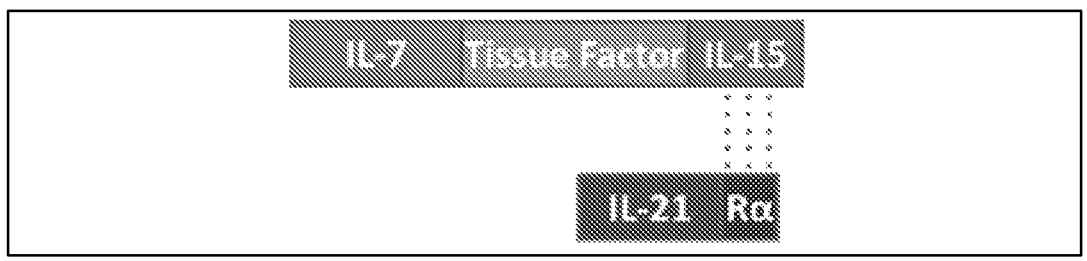
FIG. 71 shows a schematic diagram of the interaction between the exemplary IL-21/IL-15RαSu and IL-7/TF/IL-15 DNA constructs.
Figure 72:
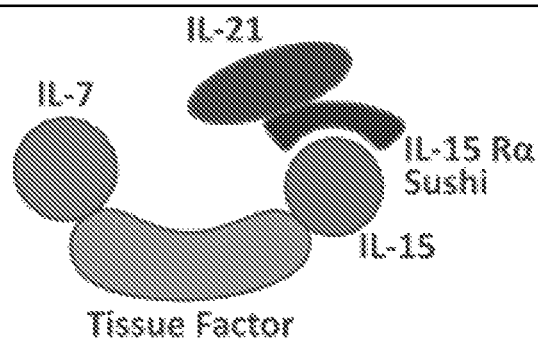
FIG. 72 shows a schematic diagram of the interaction between the exemplary IL-21/IL-15RαSu and IL-7/TF/IL-15 fusion proteins resulting in an IL-7/TF/IL-15:IL-21/IL-15RαSU complex (7t15-21s).

The IL-21/IL-15RαSu and IL-7/TF/IL-15 DNA constructs were cloned into a pMSGV-1 modified retrovirus expression vector (as described by Hughes, *Hum Gene Ther* 16:457-72, 2005, hereby incorporated by reference), and the expression vector was transfected into CHO-K1 cells. Co-expression of the two constructs in CHO-K1 cells allowed for formation and secretion of a soluble IL-7/TF/IL-15:IL-21/IL-15RαSu protein complex (referred to as 7t15-21s). The 7t15-21s protein was purified from CHO-K1 cell culture supernatant using anti-TF antibody (IgG1) affinity chromatography and size exclusion chromatography resulting in soluble (non-aggregated) protein complexes consisting of IL-21/IL-15RαSu and IL-7/TF/IL-15 fusion proteins. See FIG. 71 and FIG. 72.

Example 47: Expansion Capacity of Primary Natural Killer (NK) Cells by 7t15-21s Complex+Anti-TF IgG1 Antibody To assess the 7t15-21s complex's ability to expand primary natural killer (NK) cells, 7t15-21s complex and 7t15-21s complex+anti-TF IgG1 antibody are added to NK cells obtained from samples of fresh human leukocytes. Cells are stimulated with 50 nM of 7t15-21s complex with or without 25 nM of anti-TF IgG1 or anti-TF IgG4 antibody at 37° and 5% $CO_2$. Cells are maintained at concentration at $0.5\times10^6$/mL not exceeding $2.0\times10^6$/mL by counting every 48-72 hours and media is replenished with fresh stimulator. Cells stimulated with 7t15-21s complex or anti-TF IgG1 antibody or anti-TFIgG4 antibody or anti-TF IgG4+7t15-21s complex are maintained up to day 5. Expansion of primary NK cells upon incubation with 21t15-7s complex+anti-TF IgG1 antibody is observed.

Example 48: Activation of Expanded NK Cells by the 7t15-21s Complex+Anti-TF IgG1 Antibody Primary NK cells are induced ex vivo following overnight stimulation of purified NK cells with 7t15-21s complex+anti-TF IgG1 antibody. Fresh human leukocytes are obtained from a blood bank and CD56+ NK cells are isolated with the RosetteSep/human NK cell reagent (StemCell Technologies). The purity of NK cells is >80% and is confirmed by staining with CD56-BV421 and CD16-BV510 specific antibodies (BioLegend). Cells are counted and resuspended in $1\times10^6$/mL in a 24 well flat bottom plate in 1 mL of complete media (RPMI 1640 (Gibco), supplemented with 4 mM L-glutamine (Thermo Life Technologies), penicillin (Thermo Life Technologies), streptomycin (Thermo Life Technologies), non-essential amino acid (Thermo Life Technologies), sodium pyruvate (Thermo Life Technologies), and 10% FBS (Hyclone)). Cells are stimulated with 50 nM of 7t15-21s with or without 25 nM of anti-TF IgG1 antibody at 37° and 5% $CO_2$. Cells are counted every 48-72 hours and maintained at a concentration of $0.5\times10^6$/mL to $2.0\times10^6$/mL until day 14. Media is periodically replenished with fresh stimulator. Cells are harvested and surface stained at day 3 for CD56-BV421, CD16-BV510, CD25-PE, CD69-APCFire750 specific antibodies (Biolegend and analyzed by Flow Cytometry-Celeste-BD Bioscience). The activation marker CD25 MFI are observed to increase with 7t15-21s complex+anti-TF IgG1 antibody stimulation, but not 7t15-21s complex stimulation. The activation marker CD69 MFI is observed to increase with both 7t15-21s complex+anti-TF IgG1 antibody and with 7t15-21s complex, alone.

Example 49: Increase in Glucose Metabolism in NK Cells Using 18t15-12s

A set of experiments was performed to determine the effect of the construct of 18t15-12s on oxygen consumption rate and extracellular acidification rate (ECAR) on NK cells purified from human blood.

In these experiments, fresh human leukocytes were obtained from the blood bank from two different human donors and NK cells were isolated via negative selection using the RosetteSep/human NK cell reagent (StemCell Technologies). The purity of NK cells was >80% and confirmed by staining with CD56-BV421 and CD16-BV510 specific antibodies (BioLegend). The cells were counted and resuspended in $2\times10^6$/mL in 24-well, flat-bottom plates in 1 mL of complete media (RPMI 1640 (Gibco) supplemented with 4 mM L-glutamine (Thermo Life Technologies), penicillin (Thermo Life Technologies), streptomycin (Thermo Life Technologies), non-essential amino acid (Thermo Life Technologies), sodium pyruvate (Thermo Life Technologies) and 10% FBS (Hyclone)). The cells were stimulated with either (1) media alone, (2) 100 nM 18t15-12s, or (3) mixture of single cytokines recombinant human IL-12 (0.2514), recombinant human IL-15 (1.25 µg), and recombinant human IL-18 (1.25 µg) overnight at 37° C., 5% $CO_2$. On the next day, the cells were harvested and extracellular flux assays on expanded NK cells were performed using a XFp Analyzer (Seahorse Bioscience). The harvested cells washed and plated $2.0\times10^5$ cells/well in at least duplicate for extracellular flux analysis of OCR (Oxygen Consumption Rate) and ECAR (Extracellular Acidification Rate). The glycolysis stress tests were performed in Seahorse Media contain 2 mM of glutamine. The following were used during the assay: 10 mM glucose; 100 nM oligomycin; and 100 mM 2-deoxy-D-glycose (2DG).

Figure 73:
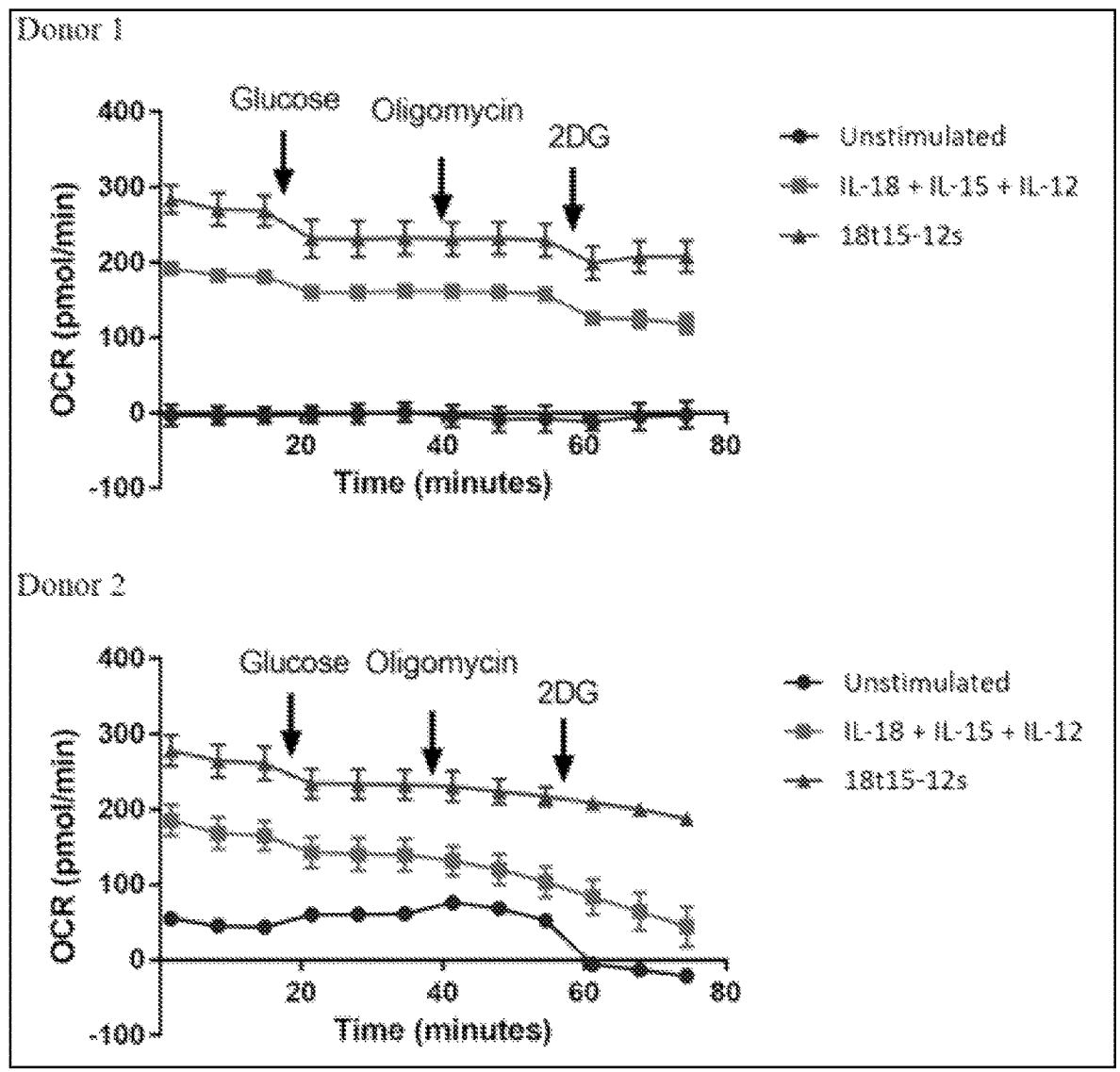
FIG. 73 shows the oxygen consumption rate (OCR) in pmoles/min for human NK cells isolated from blood ($2 \times 10^6$ cells/mL) of two different donors.
Figure 74:
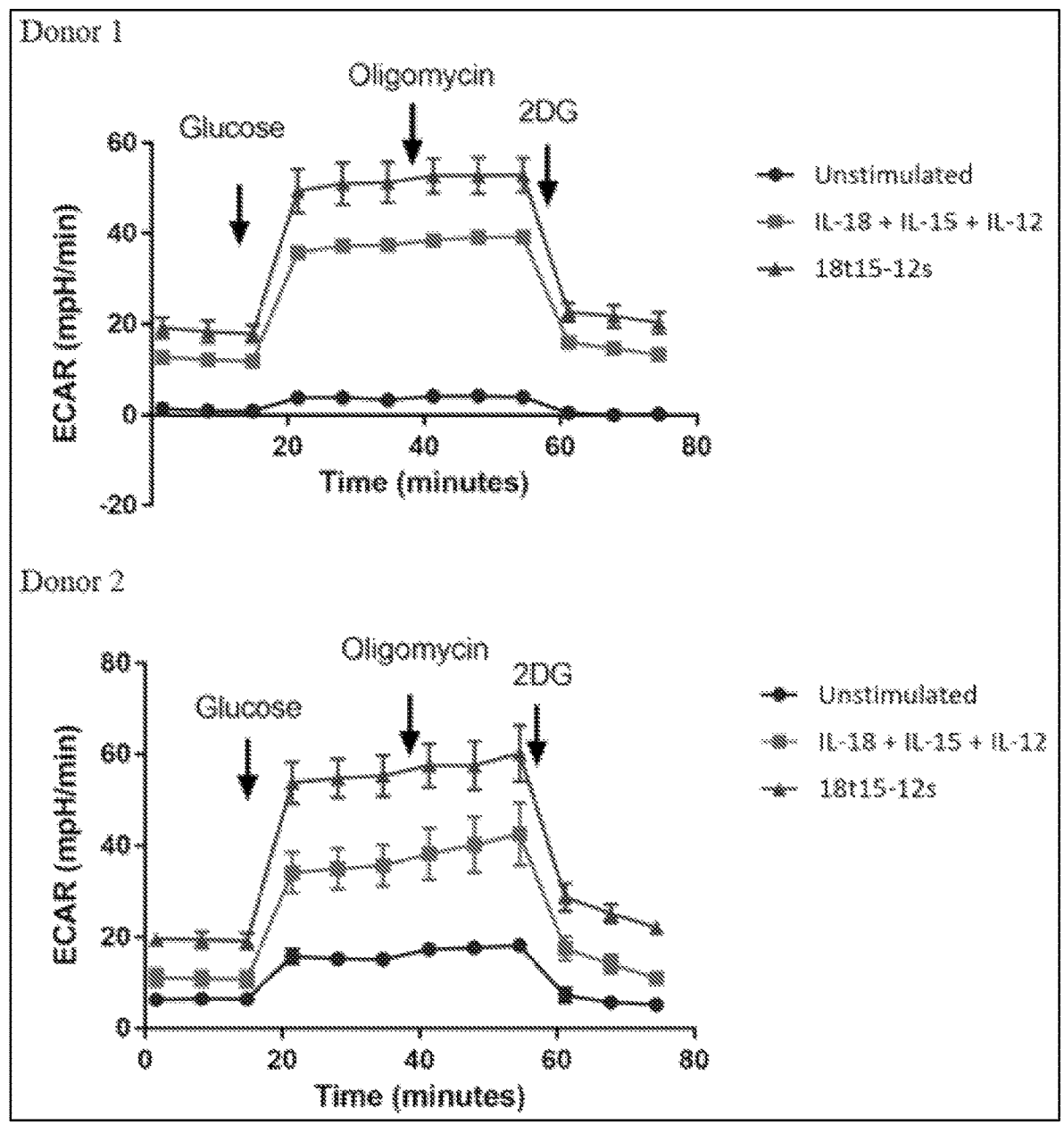
FIG. 74 shows the extracellular acidification rate (ECAR) in mpH/minute for human NK cells isolated from blood ($2 \times 10^6$ cells/mL) of two different donors.

The data show that the 18t15-12s results in significantly increased oxygen consumption rate (FIG. 73) and extracellular acidification rate (ECAR) as compared to the same cells activated with a combination of recombinant human IL-12, recombinant human IL-15, and recombinant human IL-18 (FIG. 74).

Example 50: 7t15-16s21 Fusion Protein Generation and Characterization

A fusion protein complex was generated comprising of anti-CD16scFv/IL-15RαSu/IL-21 and IL-7/TF/IL-15 fusion proteins. The human IL-7 and IL-21 sequences were obtained from the UniProt website and DNA for these sequences was synthesized by Genewiz. Specifically, a construct was made linking the IL-7 sequence to the N-terminus coding region of tissue factor 219 followed by the N-terminus coding region of IL-15.

The nucleic acid and protein sequences of a construct comprising IL-7 linked to the N-terminus of tissue factor 219 following with the N-terminus of IL-15 are shown below.

The nucleic acid sequence of the IL-7/TF/IL-15 construct (including signal peptide sequence) is as follows:

(Signal peptide)
ATGAAGTGGGTGACCTTCATCAGCCTGCTGTTCCTGTTCTCCAGCGCCT

ACTCC (Human IL-7)
GATTGCGACATCGAGGGCAAGGACGGCAAGCAGTACGAGAGCGTGCT

GATGGTGTCCATCGACCAGCTGCTGGACAGCATGAAGGAGATCGGCTCCA

ACTGCCTCAACAACGAGTTCAACTTCTTCAAGCGGCACATCTGCGACGCC

AACAAGGAGGGCATGTTCCTGTTCAGGGCCGCCAGGAAACTGCGGCAGTT

CCTGAAGATGAACTCCACCGGCGACTTCGACCTGCACCTGCTGAAGGTGT

CCGAGGGCACCACCATCCTGCTGAACTGCACCGGACAGGTGAAGGGCCGG

AAACCTGCTGCTCTGGGAGAGGCCCAACCCACCAAGAGCCTGGAGGAGAA

CAAGTCCCTGAAGGAGCAGAAGAAGCTGAACGACCTGTGCTTCCTGAAGA

GGCTGCTGCAGGAGATCAAGACCTGCTGGAACAAGATCCTGATGGGCACC

AAGGAGCAT (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC

The amino acid sequence of IL-7/TF/IL-15 fusion protein (including the leader sequence) is as follows:

(Signal peptide)
MKWVTFISLLFLFSSAYS (Human IL-7)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EH (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

Constructs were also made by linking the anti-CD16scFv sequence to the N-terminus coding region of IL-15RαSu chain followed by the N-terminus coding region of IL-21 which was synthesized by Genewiz. The nucleic acid and protein sequences of a construct comprising the anti-CD16scFv linked to the N-terminus of IL-15RαSu chain followed by the N-terminus coding region of IL-21 are shown below.

The nucleic acid sequence of the anti-CD16SscFv/IL-15 RαSu/IL-21 construct (including signal peptide sequence) is as follows:

(Signal peptide)
ATGAAGTGGGTGACCTTCATCAGCCTGCTGTTCCTGTTCTCCAGCGCCT

ACTCC ((Anti-human CD16scFv)
TCCGAGCTGACCCAGGACCCTGCTGTGTCCGTGGCTCTGGGCCAGACC

GTGAGGATCACCTGCCAGGGCGACTCCCTGAGGTCCTACTACGCCTCCTG

GTACCAGCAGAAGCCCGGCCAGGCTCCTGTGCTGGTGATCTACGGCAAGA

ACAACAGGCCCTCCGGCATCCCTGACAGGTTCTCCGGATCCTCCTCCGGC

AACACCGCCTCCCTGACCATCACAGGCGCTCAGGCCGAGGACGAGGCTGA

CTACTACTGCAACTCCAGGGACTCCTCCGGCAACCATGTGGTGTTCGGCG

GCGGCACCAAGCTGACCGTGGGCCATGGCGGCGGCGGCTCCGGAGGCGGC

GGCAGCGGCGGAGGAGGATCCGAGGTGCAGCTGGTGGAGTCCGGAGGAGG

AGTGGTGAGGCCTGGAGGCTCCCTGAGGCTGAGCTGTGCTGCCTCCGGCT

TCACCTTCGACGACTACGGCATGTCCTGGGTGAGGCAGGCTCCTGGAAAG

-continued

```
GGCCTGGAGTGGGTGTCCGGCATCAACTGGAACGGCGGATCCACCGGCTA

CGCCGATTCCGTGAAGGGCAGGTTCACCATCAGCAGGGACAACGCCAAGA

ACTCCCTGTACCTGCAGATGAACTCCCTGAGGGCCGAGGACACCGCCGTG

TACTACTGCGCCAGGGGCAGGTCCCTGCTGTTCGACTACTGGGGACAGGG

CACCCTGGTGACCGTGTCCAGG (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG (Human IL-21)
CAGGGCCAGGACAGGCACATGATCCGGATGAGGCAGCTCATCGACAT

CGTCGACCAGCTGAAGAACTACGTGAACGACCTGGTGCCCGAGTTTCTGC

CTGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGAT

CATCAACGTGAGCATCAAGAAGCTGAAGCGGAAGCCTCCCTCCACAAACG

CCGGCAGGAGGCAGAAGCACAGGCTGACCTGCCCCAGCTGTGACTCCTAC

GAGAAGAAGCCCCCCAAGGAGTTCCTGGAGAGGTTCAAGTCCCTGCTGCA

GAAGATGATCCATCAGCACCTGTCCTCCAGGACCCACGGCTCCGAGGACT

CC
```

The amino acid sequence of the anti-CD16scFv/IL-15RαSu/IL-21 construct (including signal peptide sequence) is as follows:

```
(Signal peptide)
MKWVTFISLLFLFSSAYS (Anti-human CD16scFv)
SELTQDPAVSVALGQTVRITCQGDSLRSYYASWYQQKPGQAPVLVIYGK

NNRPSGIPDRFSGSSSGNTASLTITGAQAEDEADYYCNSRDSSGNHVVFG

GGTKLTVGHGGGGSGGGGSGGGGSEVQLVESGGGVVRPGGSLRLSCAASG

FTFDDYGMSWVRQAPGKGLEWVSGINWNGGSTGYADSVKGRFTISRDNAK

NSLYLQMNSLRAEDTAVYYCARGRSLLFDYWGQGTLVTVSR (Human IL-15R α sushi domain)
ITCPPPMSVEHADIWVKSYSLYSRERYICNSGFKRKAGTSSLTECVLNKA

TNVAHWTTPSLKCIR (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS
```

In some cases, the leader peptide is cleaved from the intact polypeptide to generate the mature form that may be soluble or secreted.

Figure 75:
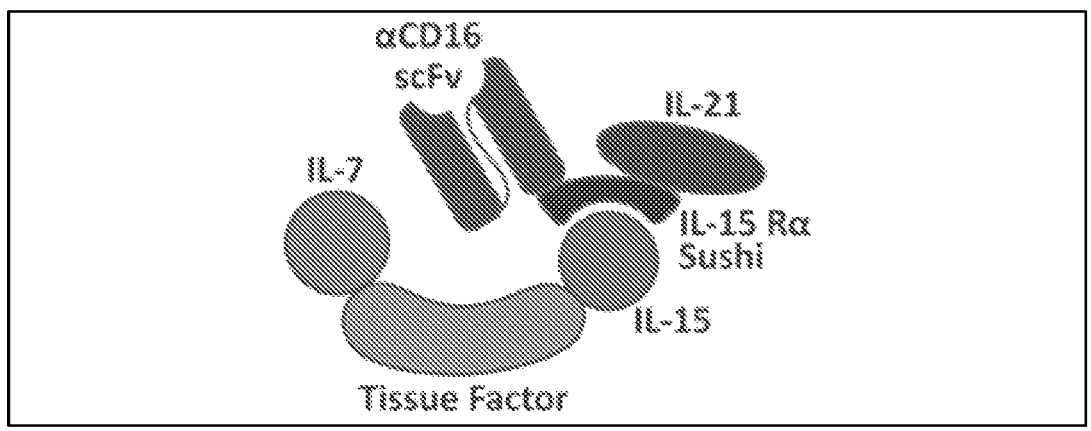
FIG. 75 shows a schematic of the 7t15-16s21 construct.
Figure 76:
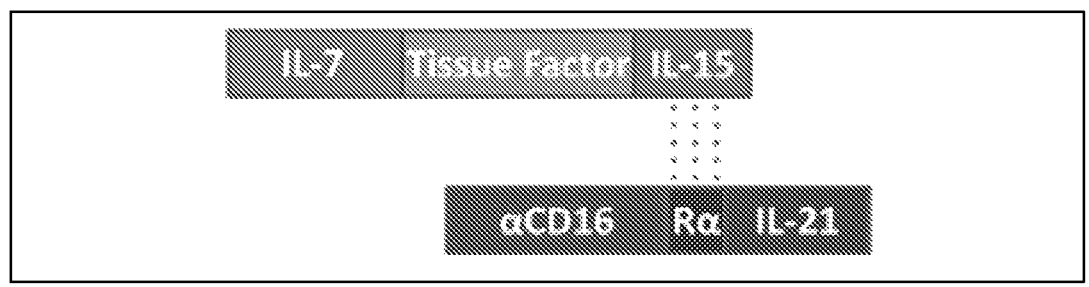
FIG. 76 shows an additional schematic of the 7t15-16s21 construct.

The anti-CD16scFv/IL-15RαSu/IL-21 and IL-7/TF/IL-15 constructs were cloned into a modified retrovirus expression vectors as described previously (Hughes M S, Yu Y Y, Dudley M E, Zheng Z, Robbins P F, Li Y, et al. Transfer of a TCR gene derived from a patient with a marked antitumor response conveys highly active T-cell effector functions. Hum Gene Ther 2005; 16:457-72), and the expression vectors were transfected into CHO-KI cells. Co-expression of the two constructs in CHO-K1 cells allowed for formation and secretion of the soluble IL-7/TF/IL-15:anti-CD16scFv/IL-15RαSu/IL-21 protein complex (referred to as 7t15-16s21; FIG. 75 and FIG. 76), which can be purified by anti-TF IgG1 antibody-based affinity and other chromatography methods.

Binding of 7t15-16s21 to CHO Cells Expressing Human CD16b

Figure 77A:
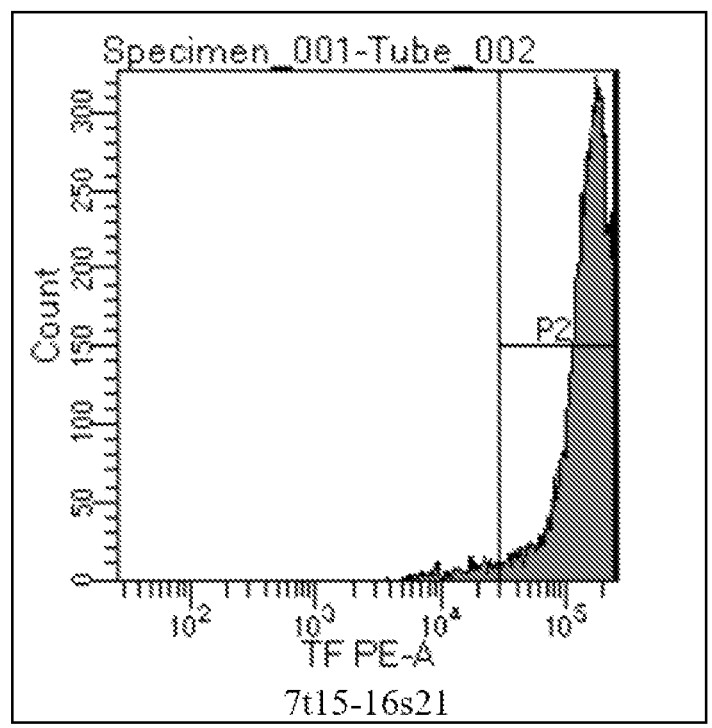
FIGS. 77A and 77B show binding of 7t15-16s21 to CHO cells expressing human CD16b as compared to a control protein.
Figure 77B:
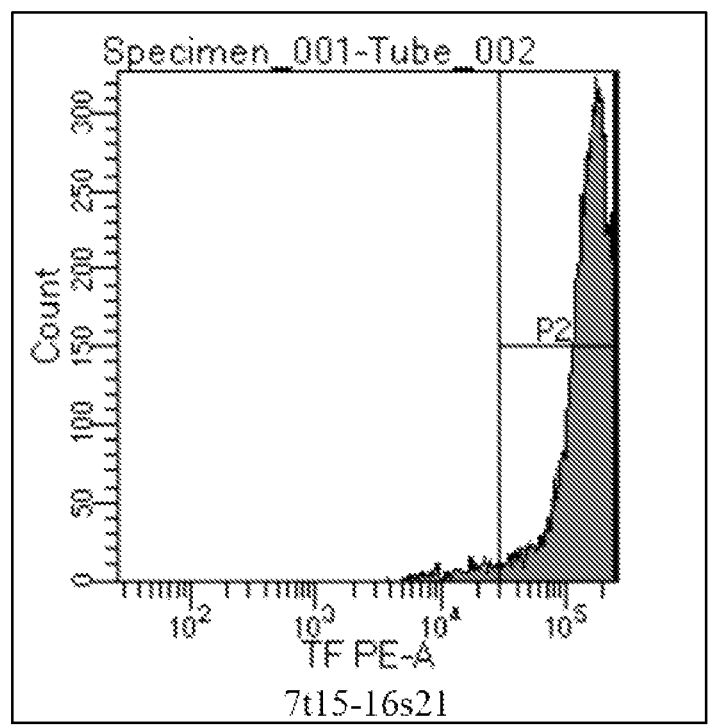

CHO cells were transfected with human CD16b in a pMC plasmid and selected with 101.1 g/mL of blasticidin for 10 days. The CHO cells stably expressing CD16b were stained with 1.2 µg/mL of 7t15-16s21, containing anti-human CD16 scFv or 18t15-12s, which does not contain anti-human CD16 scFv, as a negative control, and then stained with biotinylated anti-human tissue factor and PE conjugated streptavidin. Only anti-human CD16scFv containing 7t15-16s21 stained the cells as shown in FIG. 77A. 18t15-12s did not stain the CHO cells expressing human CD16b as showed in FIG. 77B.

Detection of IL-15, IL-21, and IL-7 in 7t15-16s21 Using ELISA

Figure 78A:
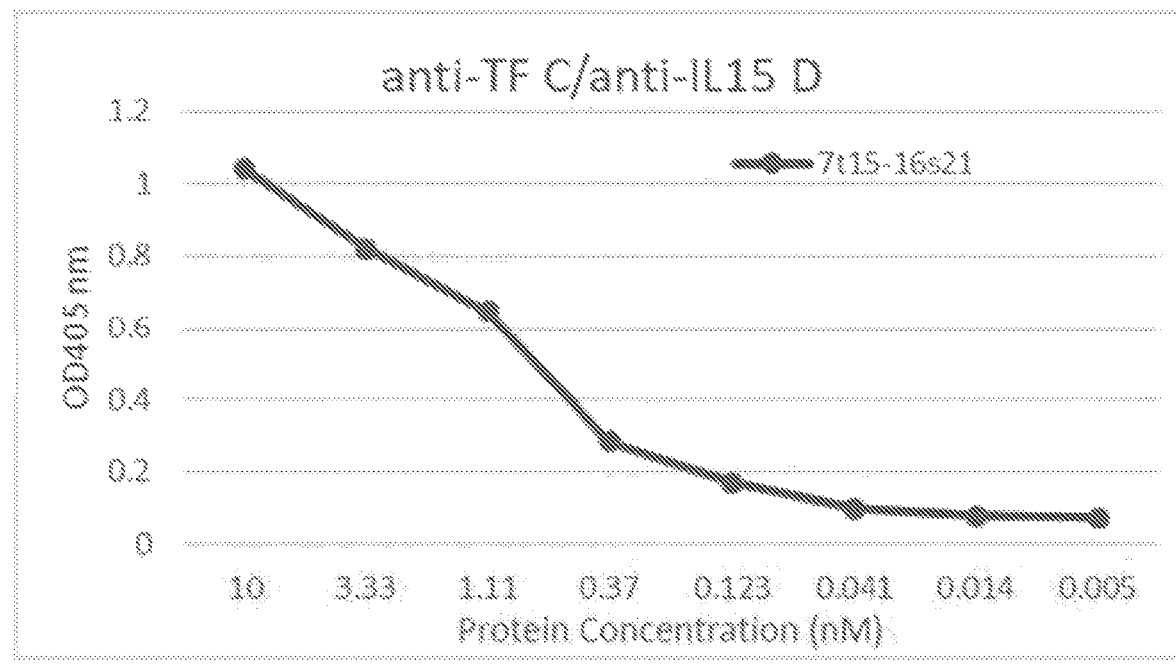
FIGS. 78A-78C are results from ELISA experiments using antibodies against IL-15, IL-21, and IL-7 in detecting 7t15-16s21.
Figure 78B:
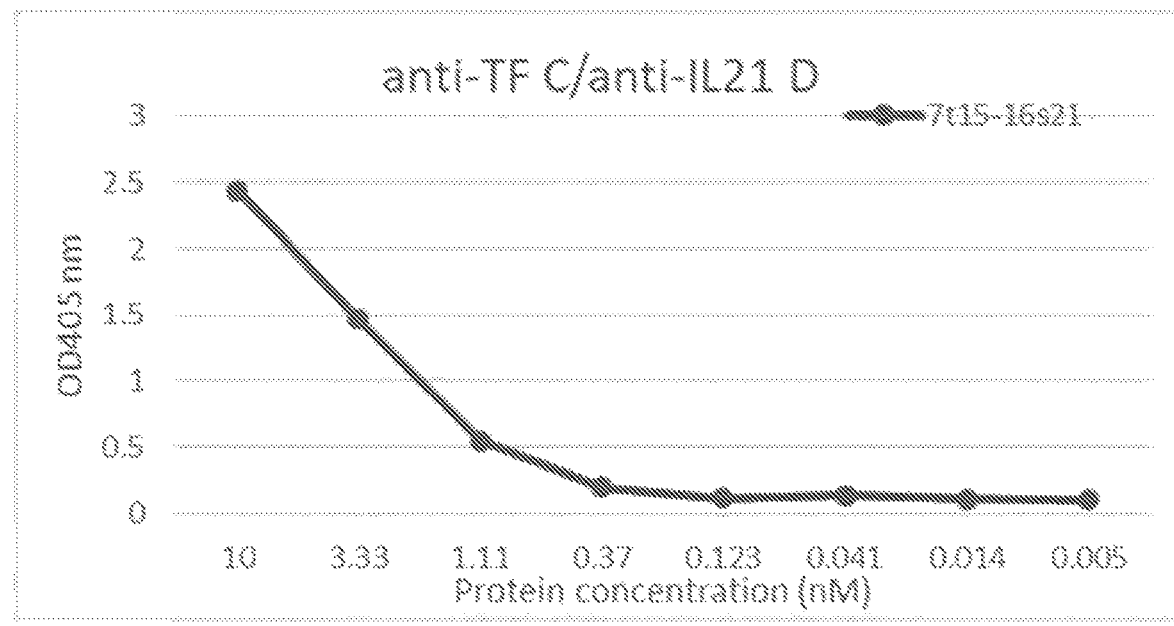
Figure 78C:
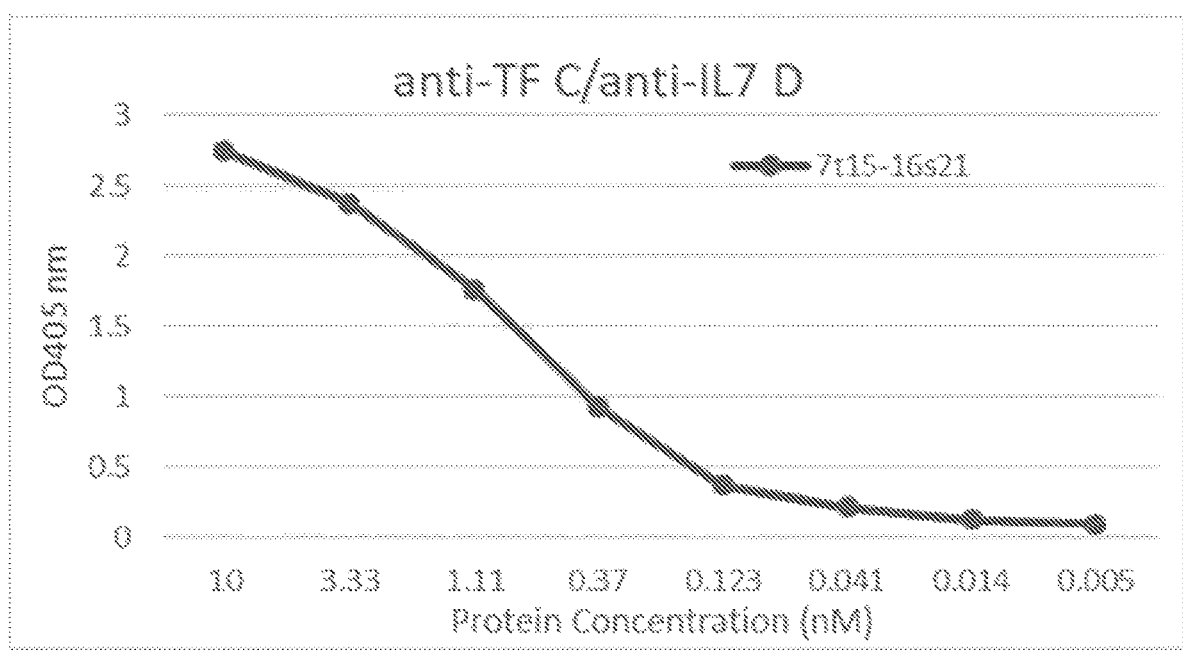

A 96-well plate was coated with 100 µL (8 µg/mL) of anti-TF IgG1 in R5 (coating buffer) and incubated at room temperature (RT) for 2 hrs. The plates were washed 3 times and blocked with 100 µL of 1% BSA in PBS. Serial dilution of 7t15-16s21 (at a 1:3 ratio) were added to the wells, and incubated at RT for 60 min. Following 3 washes, 50 ng/mL of biotinylated-anti-IL-15 antibody (BAM247, R&D Systems), 500 ng/mL of biotinylated-anti-IL-21 antibody (13-7218-81, R&D Systems), or 500 ng/mL of biotinylated-anti-IL-7 antibody (506602, R&D Systems) was added to the wells and incubated at RT for 60 min. The plate was washed 3 times, and incubated with 0.25 µg/mL of HRP-SA (Jackson ImmunoResearch) at 100 µL per well for 30 min at RT, followed by 4 washes and incubation with 100 µl of ABTS for 2 mins at RT. Absorbance was read at 405 nm. As shown in FIGS. 78A-78C, the IL-15, IL-21, and IL-7 domains in 7t15-16s21 were detected by the individual antibodies.

Figure 79:
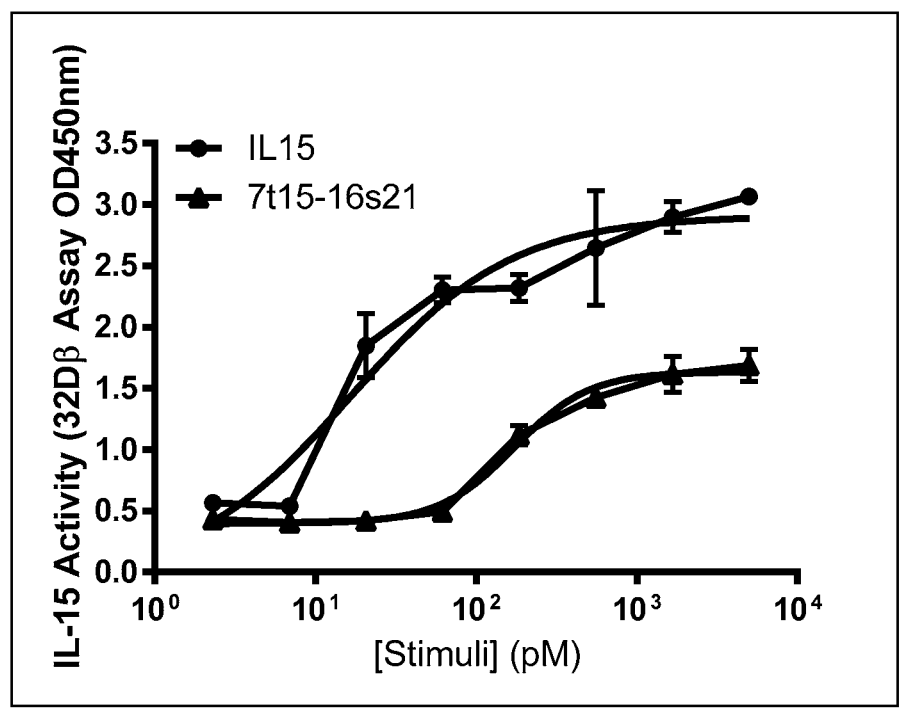
FIG. 79 shows results of the 32DP cell proliferation assay with 7t15-16s21 or recombinant IL-15.

The IL-15 in 7t15-16s21 Promotes IL-2Rβ and Common γ Chain Containing 3248 Cell proliferation To analyze the activity of IL-15 in 7t15-16s21, the IL-15 activity of 7t15-16s21 was compared to recombinant IL-15 using 3214 cells that express IL2Rβ and common 7 chain, and evaluating their effects on promoting cell proliferation. IL-15 dependent 32Dβ cells were washed 5 times with IMDM-10% FBS and seeded in the wells at $2 \times 10^4$ cells/well. Serially-diluted 7t15-16s21 or IL-15 were added to the cells (FIG. 79). Cells were incubated in a $CO_2$ incubator at 37° C. for 3 days. Cell proliferation was detected by adding 10 µl of WST1 to each well on day 3 and incubating for an additional 3 hours in a $CO_2$ incubator at 37° C. The absorbance at 450 nm was measured by analyzing the amount of formazan dye produced. As shown in FIG. 79, 7t15-16s21 and IL-15 promoted 32Dβ cell proliferation, with the $EC_{50}$ of 7t15-16s21 and IL-15 being 172.2 pM and 16.63 pM, respectively.

Figure 80:
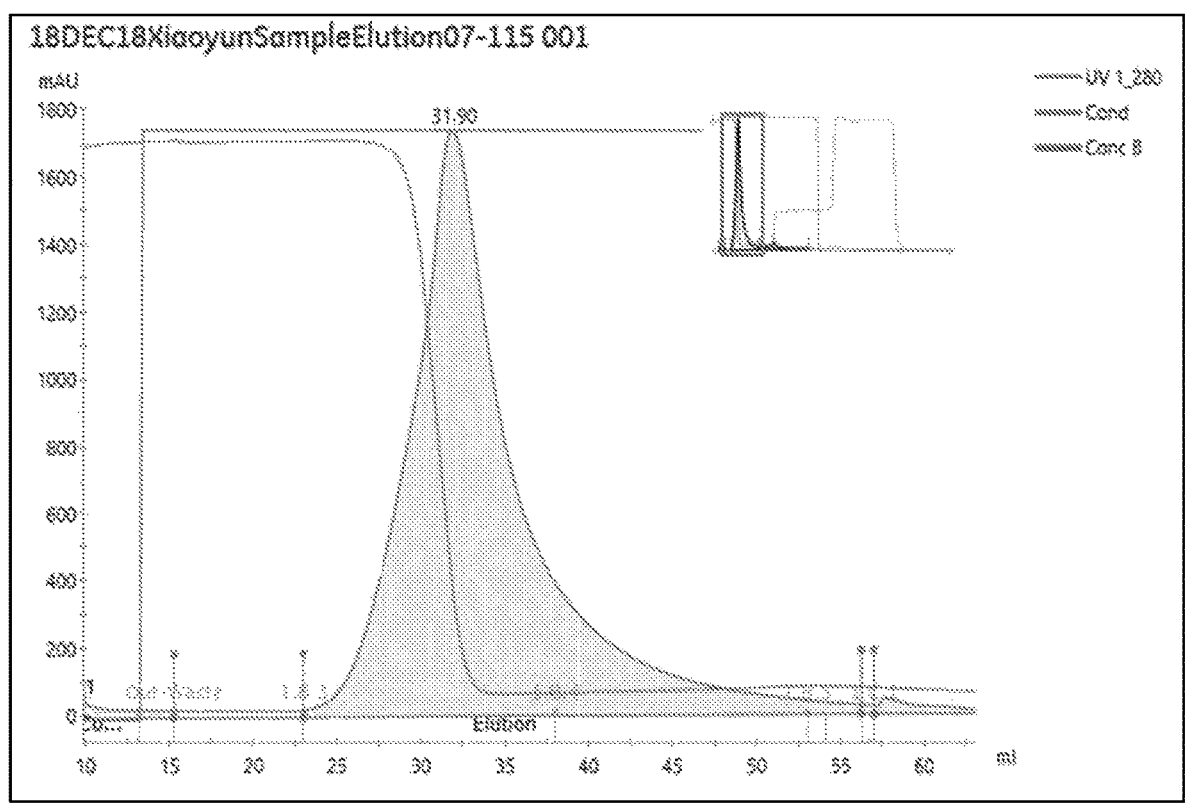
FIG. 80 shows the chromatographic profile of 7t15-16s21 protein containing cell culture supernatant following binding and elution on anti-TF antibody resin.

Purification Elution Chromatograph of 7t15-16s21 from Anti-TF Antibody Affinity Column 7t15-16s21 harvested from cell culture was loaded onto the anti-TF antibody affinity column equilibrated with 5 column volumes of PBS. The column was then washed with 5 column volumes of PBS, followed by elution with 6 column volumes of 0.1M acetic acid (pH 2.9). A280 elution peak was collected and neutralized to pH 7.5-8.0 with 1M Tris base. The neutralized sample was buffer exchanged into PBS using Amicon centrifugal filters with a 30 KDa molecular weight cutoff. FIG. 80 is a line graph showing the chromatographic profile of 7t15-16s21 protein containing cell culture supernatant following binding and elution on anti-TF antibody resin. As shown in FIG. 80, the anti-TF antibody affinity column bound 7t15-16s21 which contains TF. The buffer-exchanged protein sample was stored at 2-8° C. for further biochemical analyses and biological activity tests. After each elution, the anti-TF antibody affinity column was stripped using 6 column volumes of 0.1M glycine (pH 2.5). The column was then neutralized using 5 column volumes of PBS, and 7 column volumes of 20% ethanol for storage. The anti-TF antibody affinity column was connected to a GE Healthcare AKTA Avant system. The flow rate was 4 mL/min for all steps except for the elution step, which was 2 mL/min.

Analytical Size Exclusion Chromatography (SEC) Analysis of 7t15-16s21

Figure 81:
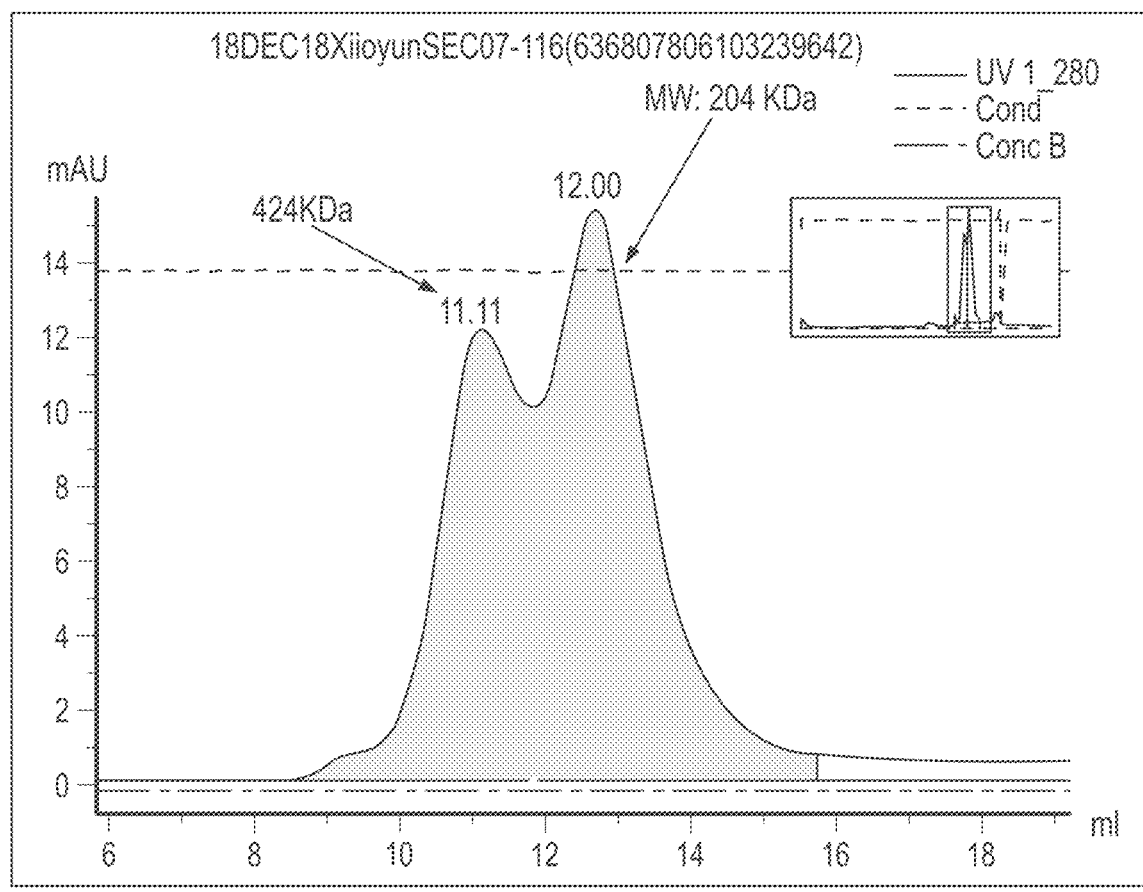
FIG. 81 shows the analytical SEC Profile of 7t15-16s21.

To perform size exclusion chromatography (SEC) analysis for 7t15-16s21, a Superdex 200 Increase 10/300 GL gel filtration column (GE Healthcare) connected to an AKTA Avant system (GE Healthcare) was used. The column was equilibrated with 2 column volumes of PBS. The flow rate was 0.7 mL/min. A sample containing 7t15-16s21 in PBS was injected into the Superdex 200 column using a capillary loop, and analyzed by SEC. As shown in FIG. 81, the SEC results showed two protein peaks for 7t15-16s21.

Example 51: TGFRt15-16s21 Fusion Protein Generation and Characterization

Figure 82:
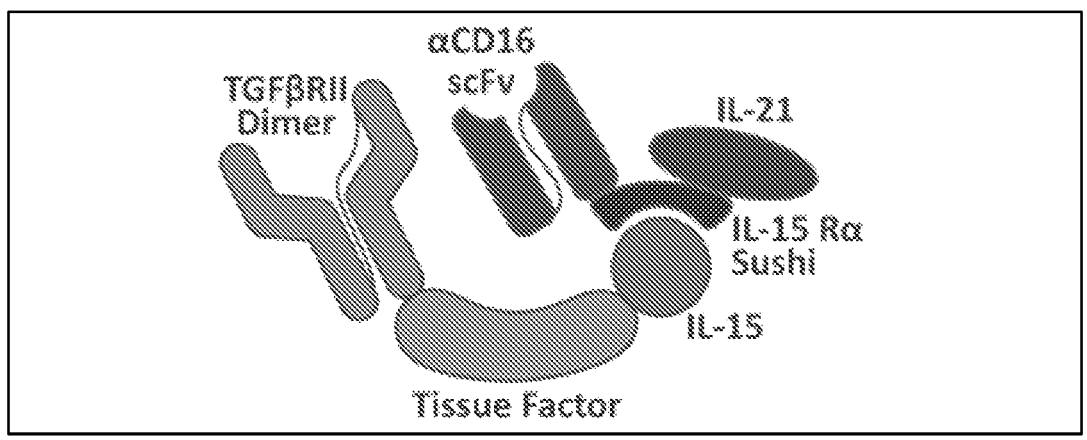
FIG. 82 shows a schematic of the TGFRt15-16s21 construct.
Figure 83:
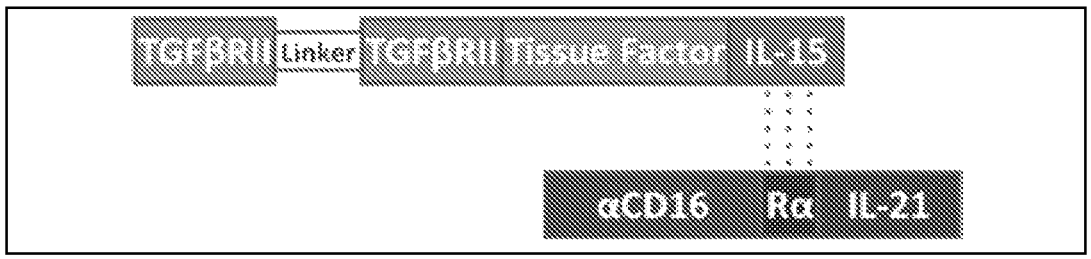
FIG. 83 shows an additional schematic of the TGFRt15-16s21 construct.

A fusion protein complex was generated comprising anti-human CD16scFv/IL-15RαSu/IL21 and TGFβ Receptor II/TF/IL-15 fusion proteins (FIGS. 82 and 83). The human TGFβ Receptor II (Ile24-Asp159), tissue factor 219, and IL-15 sequences were obtained from the UniProt website and DNA for these sequences was synthesized by Genewiz. Specifically, a construct was made linking two TGF Receptor II sequences with a G4S(3) linker to generate a single chain version of TGFβ Receptor II and then directly linking to the N-terminus coding region of tissue factor 219 followed by the N-terminus coding region of IL-15.

The nucleic acid and protein sequences of a construct comprising two TGFβ Receptor II linked to the N-terminus of tissue factor 219 following with the N-terminus of IL-15 are shown below.

The nucleic acid sequence of the two TGFβ Receptor II/TF/IL-15 construct (including signal peptide sequence) is as follows:

(Signal peptide)
ATGAAGTGGGTGACCTTCATCAGCCTGCTGTTCCTGTTCTCCAGCGCCT

ACTCC (Two Human TGFβ Receptor II fragments)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCAGCA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG

CAACCCTGATGGAGGTGGCGGATCCGGAGGTGGAGGTTCTGGTGGAGGTG

GGAGTATTCCTCCCCACGTGCAGAAGAGCGTGAATAATGACATGATCGTG

ACCGATAACAATGGCGCCGTGAAATTTCCCCAGCTGTGCAAATTCTGCGA

TGTGAGGTTTTCCACCTGCGACAACCAGAAGTCCTGTATGAGCAACTGCT

CCATCACCTCCATCTGTGAGAAGCCTCAGGAGGTGTGCGTGGCTGTCTGG

CGGAAGAATGACGAGAATATCACCCTGGAAACCGTCTGCCACGATCCCAA

GCTGCCCTACCACGATTTCATCCTGGAAGACGCCGCCAGCCCTAAGTGCA

TCATGAAAGAGAAAAAGAAGCCTGGCGAGACCTTTTTCATGTGCTCCTGC

AGCAGCGACGAATGCAACGACAATATCATCTTTAGCGAGGAATACAATAC

CAGCAACCCCGAC (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC

The amino acid sequence of TGFβ Receptor II/TF/IL-15 fusion protein (including the leader sequence) is as follows:

(Signal peptide)
MKWVTFISLLFLFSSAYS (Human TGFβ Receptor II)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

```
KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS
```

Constructs were also made by attaching anti-human CD16scFv directly linking to the N-terminus coding region of IL-15RαSu chain followed by the N-terminus coding region of IL-21 which was synthesized by Genewiz. The nucleic acid and protein sequences of a construct comprising the anti-human CD16scFv linked to the N-terminus of IL-15RαSu followed by the N-terminus coding region of IL-21 are shown below.

The nucleic acid sequence of the anti-CD16scFv/IL-15RαSu/IL-21 construct (including signal peptide sequence) is as follows:

```
(Signal peptide)
ATGAAGTGGGTGACCTTCATCAGCCTGCTGTTCCTGTTCTCCAGCGCCT

ACTCC (Anti-human CD16scFv)
TCCGAGCTGACCCAGGACCCTGCTGTGTCCGTGGCTCTGGGCCAGACC

GTGAGGATCACCTGCCAGGGCGACTCCCTGAGGTCCTACTACGCCTCCTG

GTACCAGCAGAAGCCCGGCCAGGCTCCTGTGCTGGTGATCTACGGCAAGA

ACAACAGGCCCTCCGGCATCCCTGACAGGTTCTCCGGATCCTCCTCCGGC

AACACCGCCTCCCTGACCATCACAGGCGCTCAGGCCGAGGACGAGGCTGA

CTACTACTGCAACTCCAGGGACTCCTCCGGCAACCATGTGGTGTTCGGCG

GCGGCACCAAGCTGACCGTGGGCCATGGCGGCGGCGCTCCGGAGGCGGC

GGCAGCGGCGGAGGAGGATCCGAGGTGCAGCTGGTGGAGTCCGGAGGAGG

AGTGGTGAGGCCTGGAGGCTCCCTGAGGCTGAGCTGTGCTGCCTCCGGCT

TCACCTTCGACGACTACGGCATGTCCTGGGTGAGGCAGGCTCCTGGAAAG

GGCCTGGAGTGGGTGTCCGGCATCAACTGGAACGGCGGATCCACCGGCTA

CGCCGATTCCGTGAAGGGCAGGTTCACCATCAGCAGGGACAACGCCAAGA

ACTCCCTGTACCTGCAGATGAACTCCCTGAGGGCCGAGGACACCGCCGTG

TACTACTGCGCCAGGGGCAGGTCCCTGCTGTTCGACTACTGGGGACAGGG

CACCCTGGTGACCGTGTCCAGG (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG (Human IL-21)
CAGGGCCAGGACAGGCACATGATCCGGATGAGGCAGCTCATCGACAT

CGTCGACCAGCTGAAGAACTACGTGAACGACCTGGTGCCCGAGTTTCTGC

CTGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGAT

CATCAACGTGAGCATCAAGAAGCTGAAGCGGAAGCCTCCCTCCACAAACG

CCGGCAGGAGGCAGAAGCACAGGCTGACCTGCCCCAGCTGTGACTCCTAC

GAGAAGAAGCCCCCCAAGGAGTTCCTGGAGAGGTTCAAGTCCCTGCTGCA

GAAGATGATCCATCAGCACCTGTCCTCCAGGACCCACGGCTCCGAGGACT

CC
```

The amino acid sequence of the anti-CD16scFv/IL-15RαSu/IL-21 construct (including signal peptide sequence) is as follows:

```
(Signal peptide)
MKWVTFISLLFLFSSAYS (Anti-human CD16scFv)
SELTQDPAVSVALGQTVRITCQGDSLRSYYASWYQQKPGQAPVLVIYGK

NNRPSGIPDRFSGSSSGNTASLTITGAQAEDEADYYCNSRDSSGNHVVFG

GGTKLTVGHGGGGSGGGGSGGGGSEVQLVESGGGVVRPGGSLRLSCAASG

FTFDDYGMSWVRQAPGKGLEWVSGINWNGGSTGYADSVKGRFTISRDNAK

NSLYLQMNSLRAEDTAVYYCARGRSLLFDYWGQGTLVTVSR (Human IL-15R α sushi domain)
ITCPPPMSVEHADIWVKSYSLYSRERYICNSGFKRKAGTSSLTECVLNKA

TNVAHWTTPSLKCIR (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS
```

In some cases, the leader peptide is cleaved from the intact polypeptide to generate the mature form that may be soluble or secreted.

The anti-CD16scFv/IL-15RαSu/IL-21 and TGFR/TF/IL-15 constructs were cloned into a modified retrovirus expression vectors as described previously (Hughes M S, Yu Y Y, Dudley M E, Zheng Z, Robbins P F, Li Y, et al. Transfer of a TCR gene derived from a patient with a marked antitumor response conveys highly active T-cell effector functions. *Hum Gene Ther* 2005; 16:457-72), and the expression vectors were transfected into CHO-K1 cells. Co-expression of the two constructs in CHO-K1 cells allowed for formation and secretion of the soluble TGFR/TF/IL-15:CD16scFv/IL-15RαSu/IL-21 protein complex (referred to as TGFRt15-16s21), which can be purified by anti-TF IgG1-based affinity and other chromatography methods.

Interaction Between TGFRt15-16s21 and CHO Cells Expressing Human CD16b

Figure 84A:
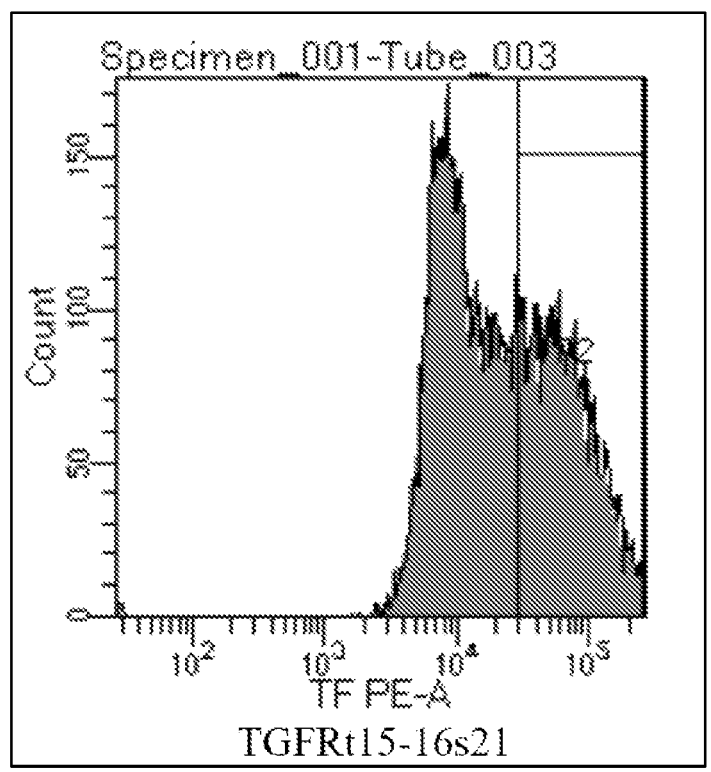
FIGS. 84A and 84B show binding affinity of TGFRT15-16S21 and 7t15-21s with CHO cells expressing human CD16b.
Figure 84B:
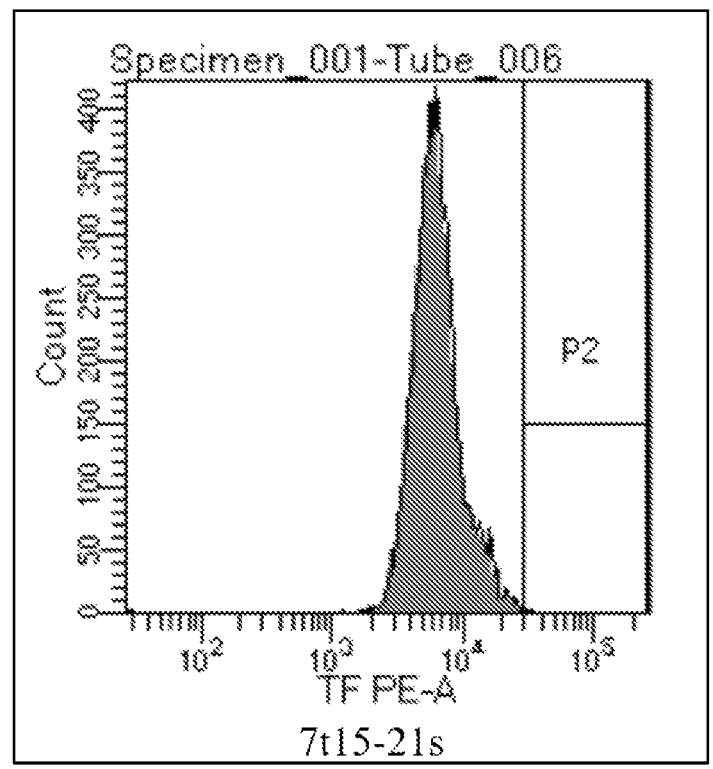

CHO cells were transfected with human CD16b in a pMC plasmid and selected with 10 μg/mL of blasticidin for 10 days. Cells stably expressing CD16b were stained with 1.2 μg/mL of TGFRt15-16s21, containing anti-human CD16 scFv, or 7t15-21s, not containing anti-human CD16 scFv, as a negative control, and with biotinylated anti-human tissue factor antibody and PE conjugated streptavidin. As shown in FIGS. 84A and 84B, TGFRt15-16s21, which contains anti-human CD16scFv, showed positive binding, while 7t15-21s did not show binding.

Effect of TGFRt15-16s21 on TGF/β1 Activity in HEK-Blue TGF/β Cells

To evaluate the activity of TGFβRII in TGFRt15-16s21, the effect of TGFRt15-16s21 on the activity of TGFβ1 in HEK-Blue TGF cells was analyzed. HEK-Blue TGFβ cells (Invivogen) were washed twice with pre-warmed PBS and resuspended in the testing medium (DMEM, 10% heat-inactivated FCS, 1× glutamine, 1× anti-anti, and 2× glutamine) at $5 \times 10^5$ cells/mL. In a flat-bottom 96-well plate, 50 μl cells were added to each well ($2.5 \times 10^4$ cells/well) and followed with 50 μL 0.1 nM TGFβ1 (R&D systems). TGFRt15-16s21 or TGFR-Fc (R&D Systems) prepared at a 1:3 serial dilution was then added to the plate to reach a total volume of 200 μL. After 24 hrs of incubation at 37° C., 40 μL of induced HEK-Blue TGFβ cell supernatant was added to 160 μL pre-warmed QUANTI-Blue (Invivogen) in a flat-bottom 96-well plate, and incubated at 37° C. for 1-3 hrs. The OD values were then determined using a plate reader (Multiscan Sky) at 620-655 nM. The $IC_{50}$ of each protein sample was calculated with GraphPad Prism 7.04. The $IC_{50}$ of TGFRt15-16s21 and TGFR-Fc were 9127 pM and 460.6 pM respectively. These results showed that the TGFβRII domain in TGFRt15-16s21 was able to block the activity of TGFβ-1 in HEK-Blue TGFβ cells.

Figure 85:
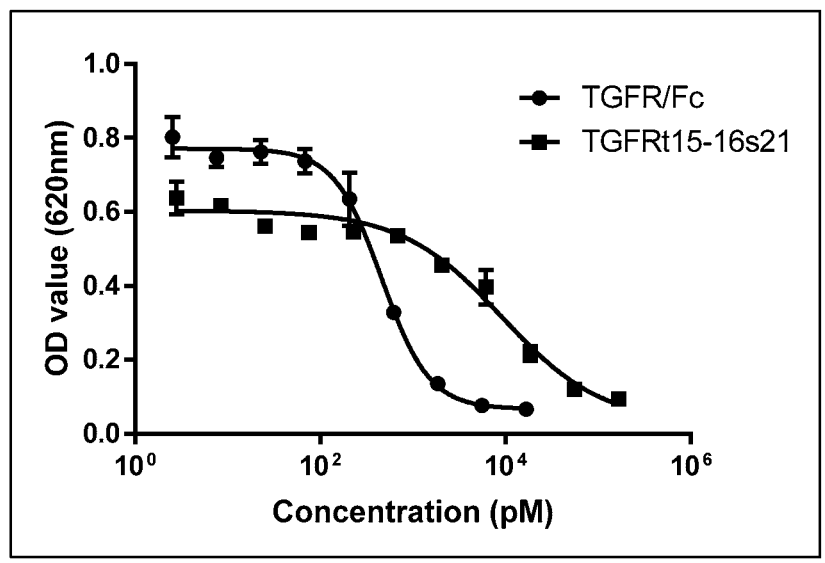
FIG. 85 shows results of TGFβ1 inhibition by TGFRt15-16s21 and TGFR-Fc.
Figure 86:
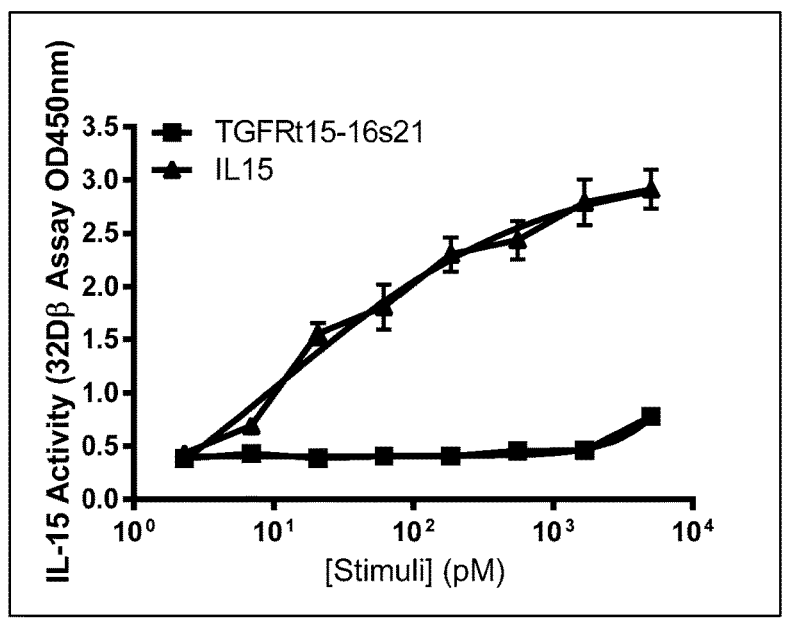
FIG. 86 shows results of 32Dβ cell proliferation assay with TGFRt15-16s21 or recombinant IL-15.

The IL-15 in TGFRt15-16s21 Promotes IL-2Rβ and Common γ Chain Containing 32Dβ Cell Proliferation To analyze the activity of IL-15 in TGFRt15-16s21, the IL-15 activity of TGFRt15-16s21 was compared to recombinant IL-15 using 32Dβ cells that express IL2Rβ and common γ chain, and evaluating their effects on promoting cell proliferation. IL-15 dependent 32Dβ cells were washed 5 times with IMDM-10% FBS and seeded in the wells at $2 \times 10^4$ cells/well. Serially-diluted TGFRt15-16s21 or IL-15 were added to the cells (FIG. 86). Cells were incubated in a $CO_2$ incubator at 37° C. for 3 days. Cell proliferation was detected by adding 10 μL of WST1 to each well on day 3 and incubating for an additional 3 hours in a $CO_2$ incubator at 37° C. The absorbance at 450 nm was measured by analyzing the amount of formazan dye produced. The data are shown in FIG. 85. As shown in FIG. 86, TGFRt15-16s21 and IL-15 promoted 321:43 cell proliferation, with the $EC_{50}$ of TGFRt15-16s21 and IL-15 being 51298 pM and 10.63 pM, respectively.

Detection of IL-15, IL-21, and TGFβRII in TGFRt15-16s21 Using ELISA

Figure 87A:
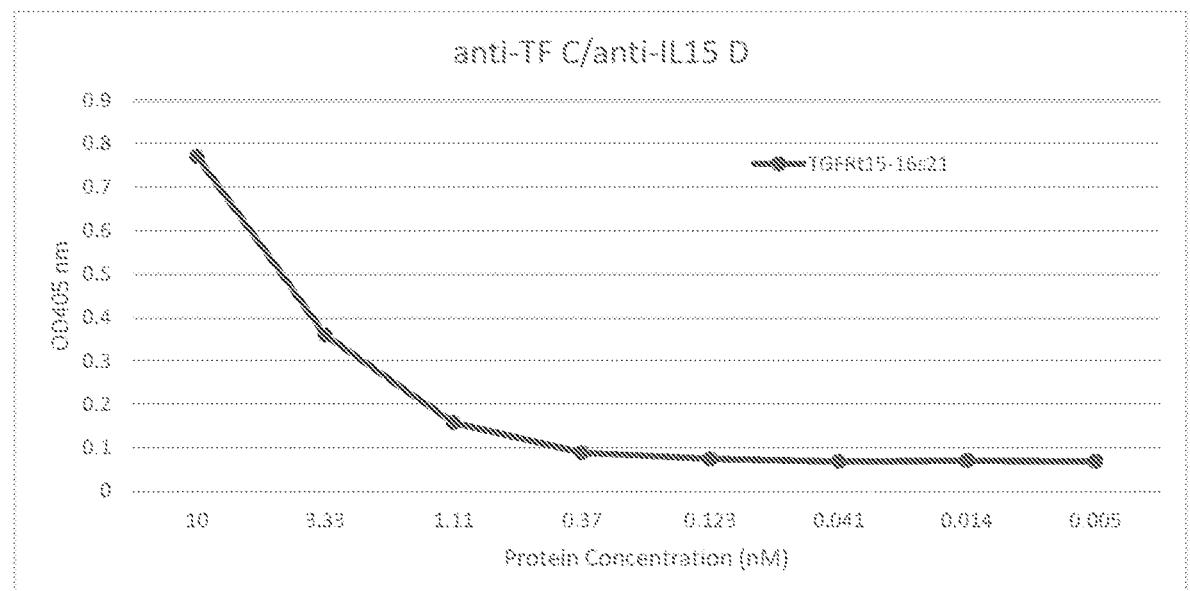
FIGS. 87A-87C show results of detecting IL-15, IL-21, and TGFβRII in TGFRt15-16s21 with corresponding antibodies using ELISA.
Figure 87B:
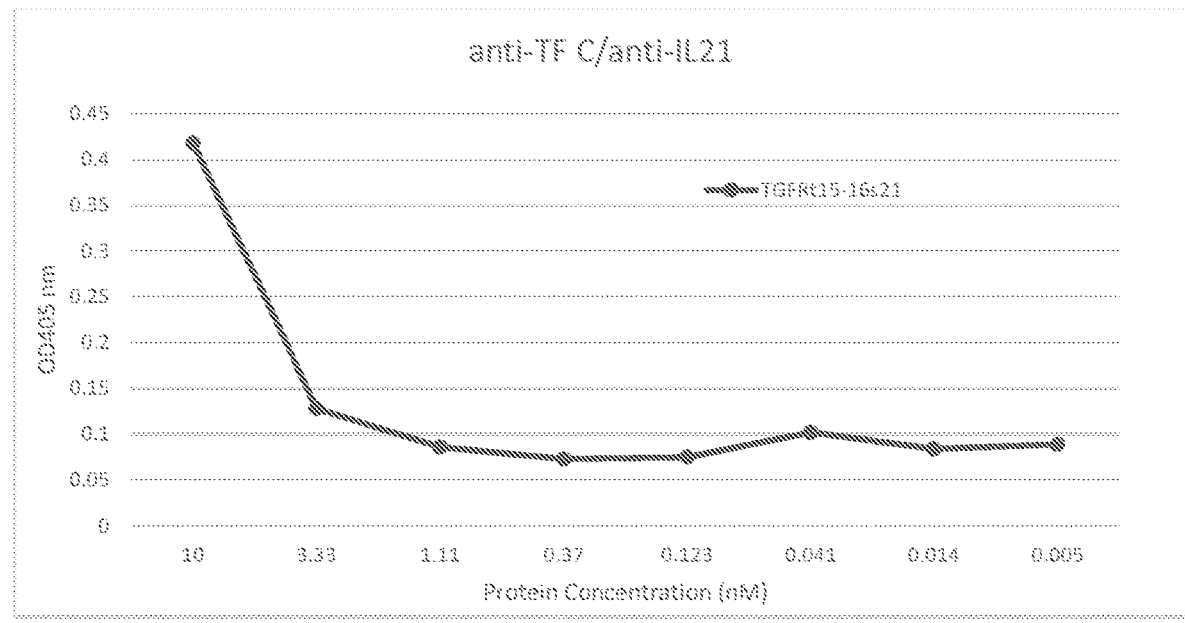
Figure 87C:
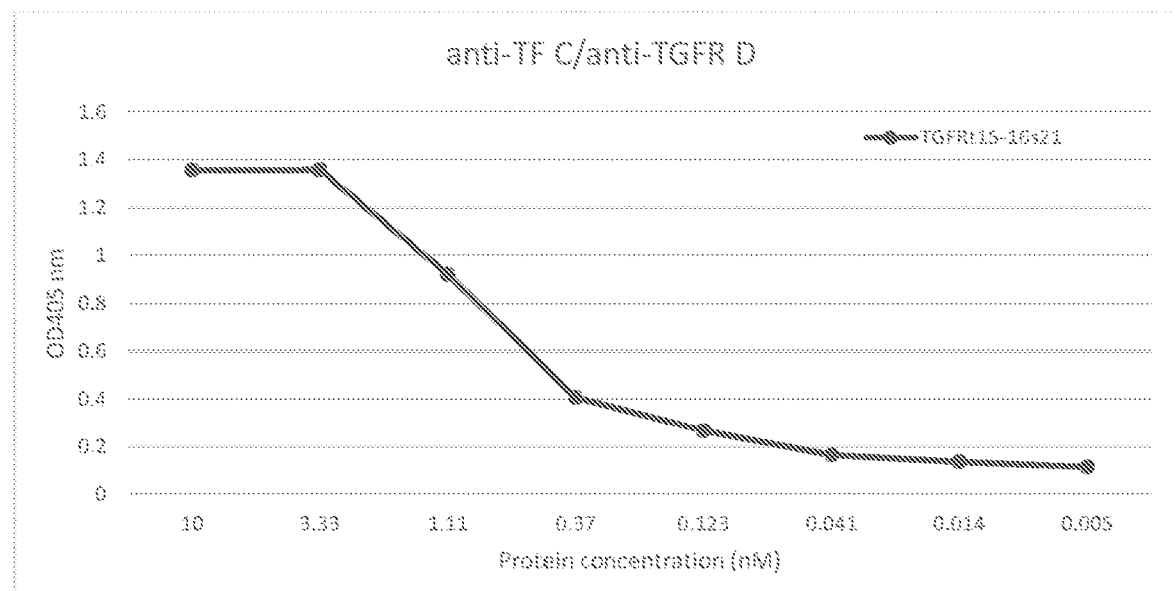

A 96-well plate was coated with 100 μL (8 μg/mL) of anti-TF IgG1 in R5 (coating buffer) and incubated at room temperature (RT) for 2 hrs. The plates were washed 3 times and blocked with 100 μL of 1% BSA in PBS. TGFRt15-16s21 serially diluted at a 1:3 ratio was added and incubated at RT for 60 min. Following three washes, 50 ng/mL of biotinylated-anti-IL-15 antibody (BAM247, R&D Systems), 500 ng/mL of biotinylated-anti-IL-21 antibody (13-7218-81, R&D Systems), or 200 ng/mL of biotinylated-anti-TGFβRII antibody (BAF241, R&D Systems) was applied per well, and incubated at RT for 60 min. Following three washes, incubation with 0.25 μg/mL of HRP-SA (Jackson ImmunoResearch at 100 μL per well for 30 min at RT was carried out, followed by 4 washes and incubation with 100 μL of ABTS for 2 mins at RT. Absorbance was read at 405 nm. As shown in FIGS. 87A-87C, the IL-15, IL-21, and TGFβRII domains in TGFRt15-16s21 were detected by the respective antibodies.

Figure 88:
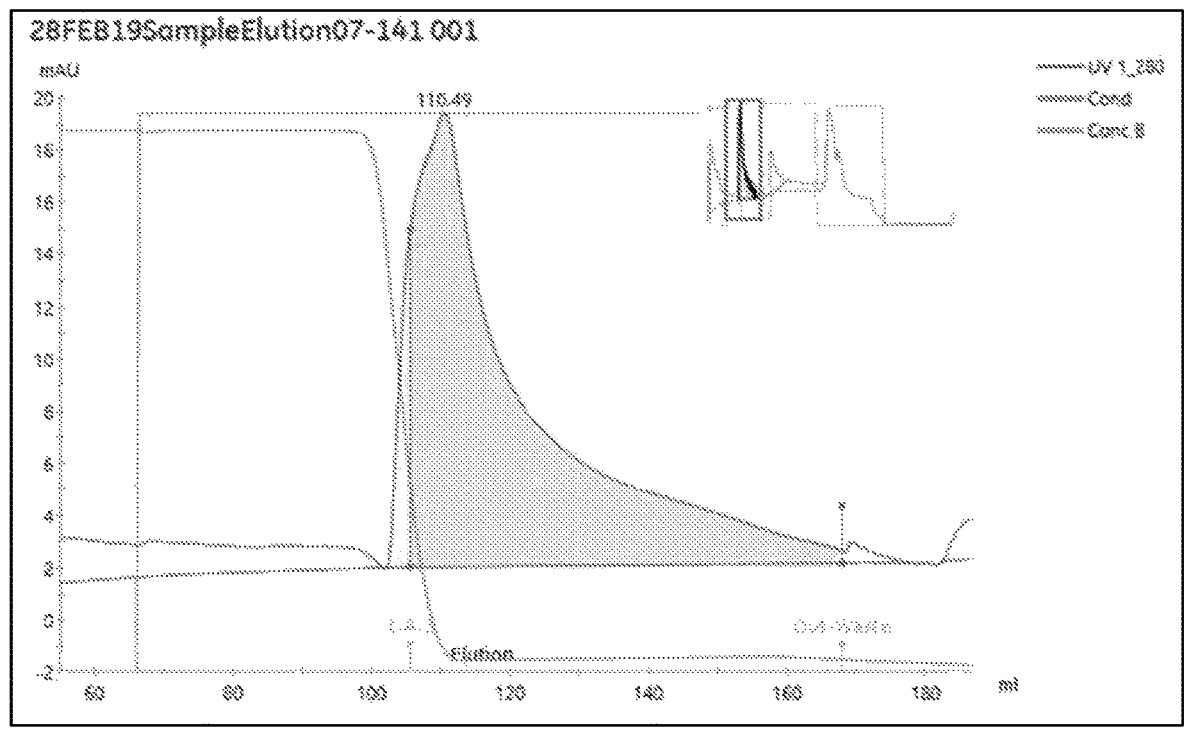
FIG. 88 shows the chromatographic profile of TGFRt15-16s21 protein containing cell culture supernatant following binding and elution on anti-TF antibody resin.

Purification Elution Chromatograph of TGFRt15-16s21 Using Anti-TF Antibody Affinity Column TGFRt15-16s21 harvested from cell culture was loaded onto the anti-TF antibody affinity column equilibrated with 5 column volumes of PBS. After sample loading, the column was washed with 5 column volumes of PBS, followed by elution with 6 column volumes of 0.1M acetic acid (pH 2.9). A280 elution peak was collected and then neutralized to pH 7.5-8.0 with 1M Tris base. The neutralized sample was then buffer exchanged into PBS using Amicon centrifugal filters with a 30 KDa molecular weight cutoff. As shown in FIG. 88, the anti-TF antibody affinity column bound to TGFRt15-16s21, which contains tissue factor as a fusion partner. The buffer-exchanged protein sample was stored at 2-8° C. for further biochemical analyses and biological activity tests. After each elution, the anti-TF antibody affinity column was stripped using 6 column volumes of 0.1M glycine (pH 2.5). The column was then neutralized using 5 column volumes of PBS, and 7 column volumes of 20% ethanol for storage. The anti-TF antibody affinity column was connected to a GE Healthcare AKTA Avant system. The flow rate was 4 mL/min for all steps except for the elution step, which was 2 mL/min.

Reduced SDS-PAGE of TGFRt15-16s21

To determine the purity and molecular weight of the TGFRt15-16s21 protein, protein sample purified with anti-TF antibody affinity column was analyzed by sodium dodecyl sulfate polyacrylamide gel (4-12% NuPage Bis-Tris gel) electrophoresis (SDS-PAGE) under reduced condition. After electrophoresis, the gel was stained with InstantBlue for about 30 min, followed by destaining overnight in purified water.

Figure 89:
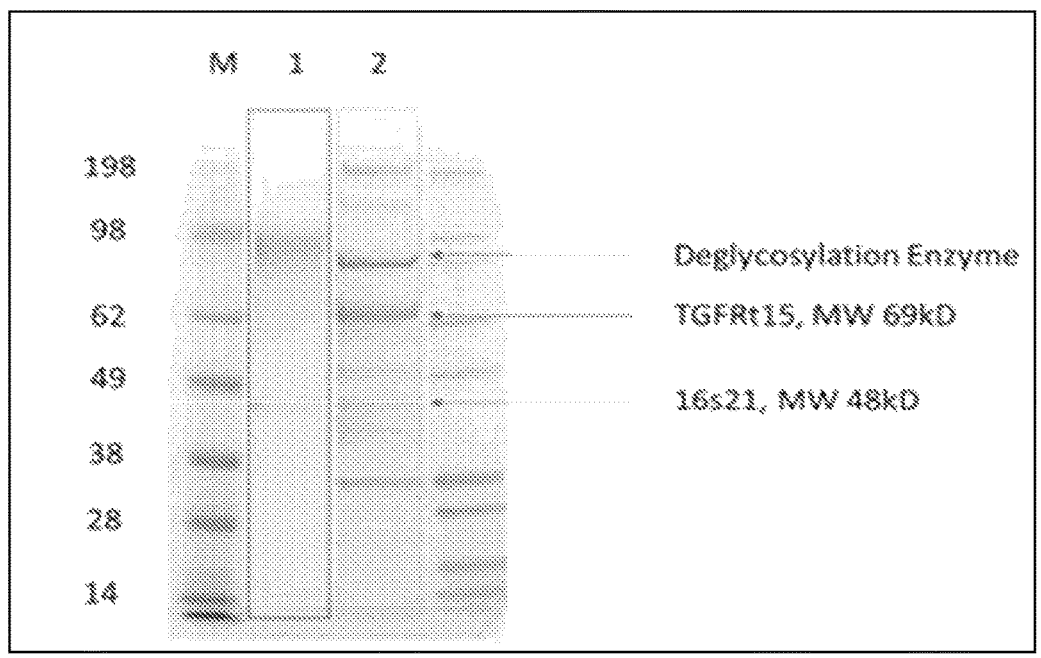
FIG. 89 shows results of a reduced SDS-PAGE analysis of TGFRt15-16s21.

To verify that the TGFRt15-16s21 protein undergoes glycosylation after translation in CHO cells, a deglycosylation experiment was conducted using the Protein Deglycosylation Mix II kit from New England Biolabs according to the manufacturer's instructions. FIG. 89 shows results from the reduced SDS-PAGE analysis of the sample in non-deglycosylated (lane 1) and deglycosylated (lane 2) state. The results showed that the TGFRt15-16s21 protein is glycosylated when expressed in CHO cells. After deglycosylation, the purified sample showed expected molecular weights (69 kDa and 48 kDa) in the reduced SDS gel. Lane M was loaded with 10 μL of SeeBlue Plus2 Prestained Standard.

Example 52: 7t15-7s Fusion Protein Generation and Characterization

Figure 90:
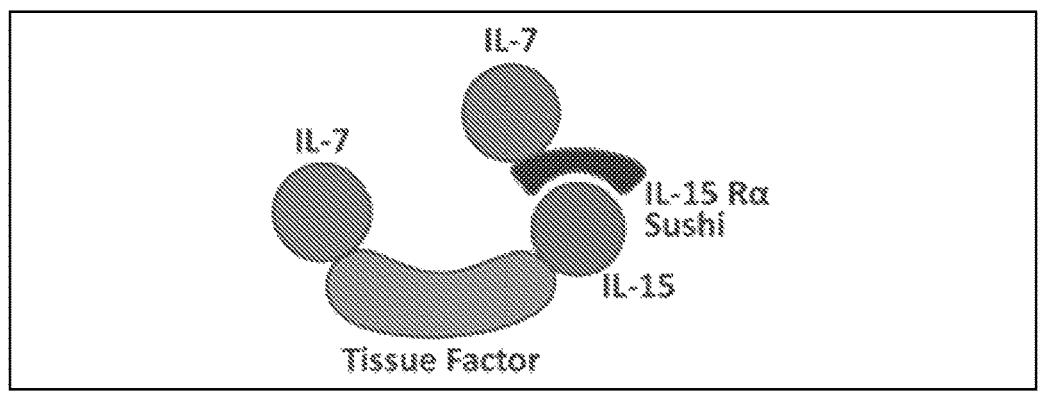
FIG. 90 shows a schematic of the 7t15-7s construct.
Figure 91:
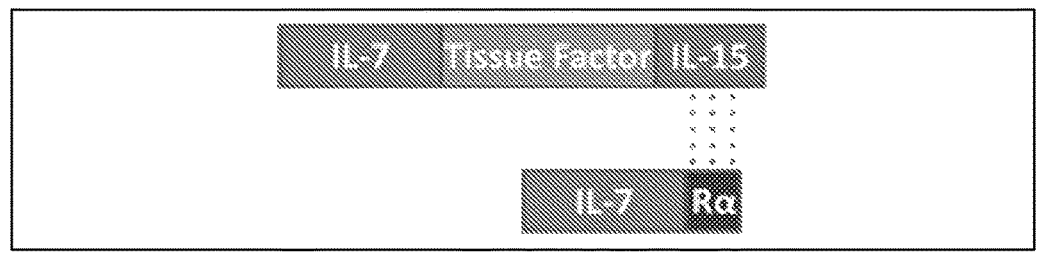
FIG. 91 shows an additional schematic of the 7t15-7s construct.

A fusion protein complex was generated comprising IL-7/TF/IL-15 and IL-7/IL-15RαSu fusion proteins (FIG. 90 and FIG. 91). The human IL-7, tissue factor 219, and IL-15 sequences were obtained from the UniProt website and DNA for these sequences was synthesized by Genewiz. Specifically, a construct was made linking the IL-7 sequence to the N-terminus coding region of tissue factor 219 followed by the N-terminus coding region of IL-15.

The nucleic acid and protein sequences of a construct comprising IL-7 linked to the N-terminus of tissue factor 219 following with the N-terminus of IL-15 are shown below.

The nucleic acid sequence of 7t15 construct (including signal peptide sequence) is as follows:

(Signal peptide)
ATGAAGTGGGTGACCTTCATCAGCCTGCTGTTCCTGTTCTCCAGCGCCT

ACTCC (Human IL7)
GATTGCGACATCGAGGGCAAGGACGGCAAGCAGTACGAGAGCGTGCT

GATGGTGTCCATCGACCAGCTGCTGGACAGCATGAAGGAGATCGGCTCCA

ACTGCCTCAACAACGAGTTCAACTTCTTCAAGCGGCACATCTGCGACGCC

AACAAGGAGGGCATGTTCCTGTTCAGGGCCGCCAGGAAACTGCGGCAGTT

CCTGAAGATGAACTCCACCGGCGACTTCGACCTGCACCTGCTGAAGGTGT

CCGAGGGCACCACCATCCTGCTGAACTGCACCGGACAGGTGAAGGGCCGG

AAACCTGCTGCTCTGGGAGAGGCCCAACCCACCAAGAGCCTGGAGGAGAA

CAAGTCCCTGAAGGAGCAGAAGAAGCTGAACGACCTGTGCTTCCTGAAGA

GGCTGCTGCAGGAGATCAAGACCTGCTGGAACAAGATCCTGATGGGCACC

AAGGAGCAT (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC

The amino acid sequence of 7t15 fusion protein (including the leader sequence) is as follows:

(Signal peptide)
MKWVTFISLLFLFSSAYS (Human IL7)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EH (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

Constructs were also made by linking the IL-7 sequence to the N-terminus coding region of IL-15RαSu chain which was synthesized by Genewiz. The nucleic acid and protein sequences of a construct comprising the IL-7 linked to the N-terminus of IL-15RαSu chain are shown below.

The nucleic acid sequence of 7s construct (including signal peptide sequence) is as follows:

(Signal peptide)
ATGAAGTGGGTGACCTTCATCAGCCTGCTGTTCCTGTTCTCCAGCGCCT

ACTCC (Human IL7)
GATTGCGACATCGAGGGCAAGGACGGCAAGCAGTACGAGAGCGTGCT

GATGGTGTCCATCGACCAGCTGCTGGACAGCATGAAGGAGATCGGCTCCA

ACTGCCTCAACAACGAGTTCAACTTCTTCAAGCGGCACATCTGCGACGCC

AACAAGGAGGGCATGTTCCTGTTCAGGGCCGCCAGGAAACTGCGGCAGTT

CCTGAAGATGAACTCCACCGGCGACTTCGACCTGCACCTGCTGAAGGTGT

CCGAGGGCACCACCATCCTGCTGAACTGCACCGGACAGGTGAAGGGCCGG

AAACCTGCTGCTCTGGGAGAGGCCCAACCCACCAAGAGCCTGGAGGAGAA

CAAGTCCCTGAAGGAGCAGAAGAAGCTGAACGACCTGTGCTTCCTGAAGA

GGCTGCTGCAGGAGATCAAGACCTGCTGGAACAAGATCCTGATGGGCACC

AAGGAGCAT (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG

The amino acid sequence of 7s fusion protein (including the leader sequence) is as follows:

(Signal peptide)
MKWVTFISLLFLFSSAYS (Human IL7)
DCDIEGKDGKQYESVLMVSIDQLLDSMKEIGSNCLNNEFNFFKRHICDAN

KEGMPLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EH (Human IL-15R α sushi domain)
ITCPPPMSVEHADIWVKSYSLYSRERYICNSGFKRKAGTSSLTECVLNKA

TNVAHWTTPSLKCIR

The IL-7/TF/IL-15 and IL-7/IL-15RαSu constructs were cloned into a modified retrovirus expression vectors as described previously (Hughes M S, Yu Y Y, Dudley M E, Zheng Z, Robbins P F, Li Y, et al. Transfer of a TCR gene derived from a patient with a marked antitumor response conveys highly active T-cell effector functions. *Hum Gene Ther* 2005; 16:457-72), and the expression vectors were transfected into CHO-K1 cells. Co-expression of the two constructs in CHO-K1 cells allowed for formation and secretion of the soluble IL-7/TF/IL-15:IL-7/IL-15RαSu protein complex referred to as 7t15-7s, which can be purified by anti-TF antibody IgG1 affinity and other chromatography methods.

Figure 92:
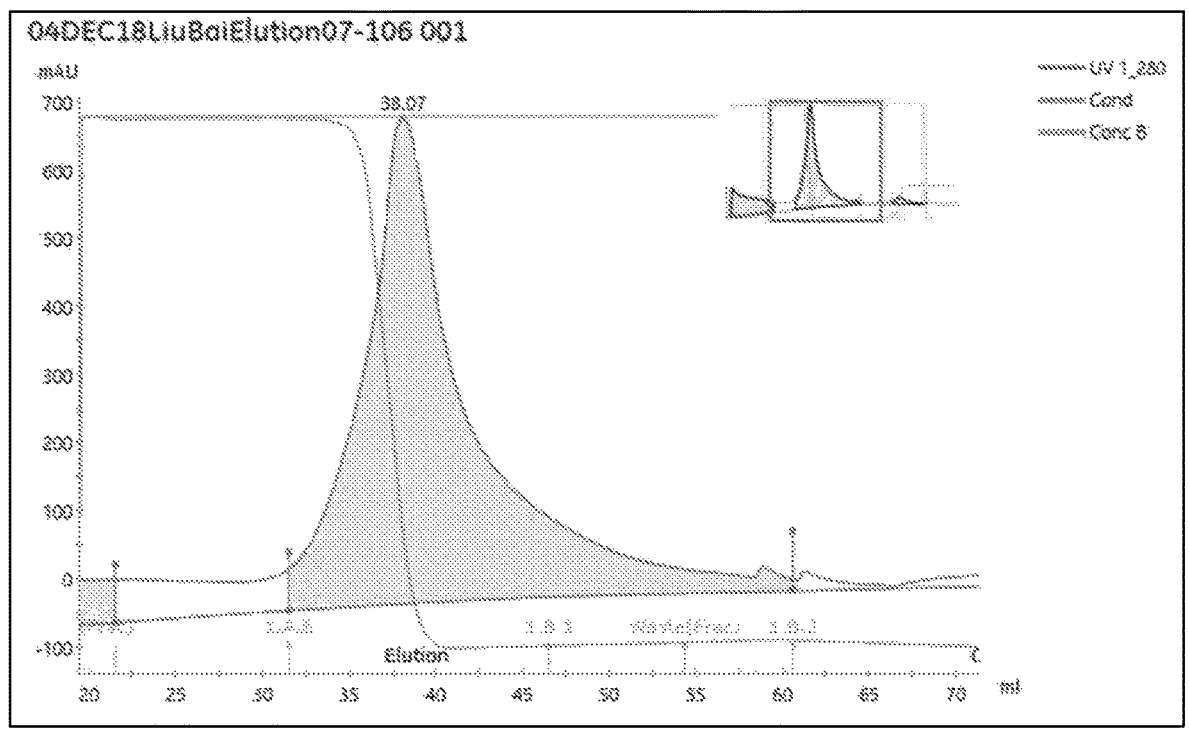
FIG. 92 shows the chromatographic profile of 7t15-7s protein containing cell culture supernatant following binding and elution on anti-TF antibody resin.

Purification Elution Chromatograph of 7t15-7s Using Anti-TF Antibody Affinity Column 7t15-7s harvested from cell culture was loaded onto the anti-TF antibody affinity column equilibrated with 5 column volumes of PBS. After sample loading, the column was washed with 5 column volumes of PBS, followed by elution with 6 column volumes of 0.1M acetic acid (pH 2.9). A280 elution peak was collected and then neutralized to pH 7.5-8.0 with 1M Tris base. The neutralized sample was then buffer exchanged into PBS using Amicon centrifugal filters with a 30 KDa molecular weight cutoff. As shown in FIG. 92, the anti-TF antibody affinity column bound to 7t15-7s which contains tissue factor (TF) as a fusion partner. The buffer-exchanged protein sample was stored at 2-8° C. for further biochemical analyses and biological activity tests. After each elution, the anti-TF antibody affinity column was stripped using 6 column volumes of 0.1M glycine (pH 2.5). The column was then neutralized using 5 column volumes of PBS, and 7 column volumes of 20% ethanol for storage. The anti-TF antibody affinity column was connected to a GE Healthcare AKTA Avant system. The flow rate was 4 mL/min for all steps except the elution step, which was 2 mL/min.

Immunostimulation of 7t15-7s in C57BL/6 Mice

7t15-7s is a multi-chain polypeptide (a type A multi-chain polypeptide described herein) that includes the first polypeptide that is a soluble fusion of human IL-7, human tissue factor 219 fragment and human IL-15 (7t15), and the second polypeptide that is a soluble fusion of human IL-7 and sushi domain of human IL-15 receptor alpha chain (7s).

Figure 93:
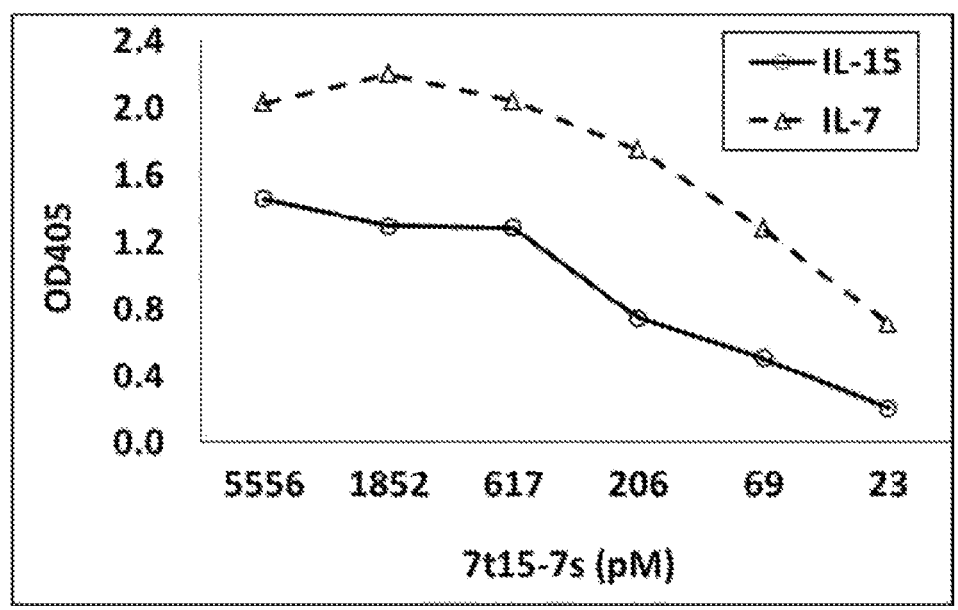
FIG. 93 shows detection of TF, IL-15 and IL-7 in 7t15-7s using ELISA.

CHO cells were co-transfected with the IL7-TF-IL-15 (7t15) and IL7-IL-15Ra sushi domain (7s) vectors. The 7t15-7s complex was purified from the transfected CHO cell culture supernatant. The IL-7, IL-15 and tissue factor (TF) components were demonstrated in the complex by ELISA as shown in FIG. 93. A humanized anti-TF antibody monoclonal antibody (anti-TF IgG1) was used as the capture antibody to determine TF in 7t15-7s, and biotinylated anti-human IL-15 antibody (R&D systems) and biotinylated anti-human IL-7 antibody (R&D Systems) were used as the detection antibodies to respectively detect IL-15 and IL-7 in 7t15-7s, followed by peroxidase conjugated streptavidin (Jackson ImmunoResearch Lab) and ABTS substrate (Surmodics IVD, Inc.).

Figure 94A:
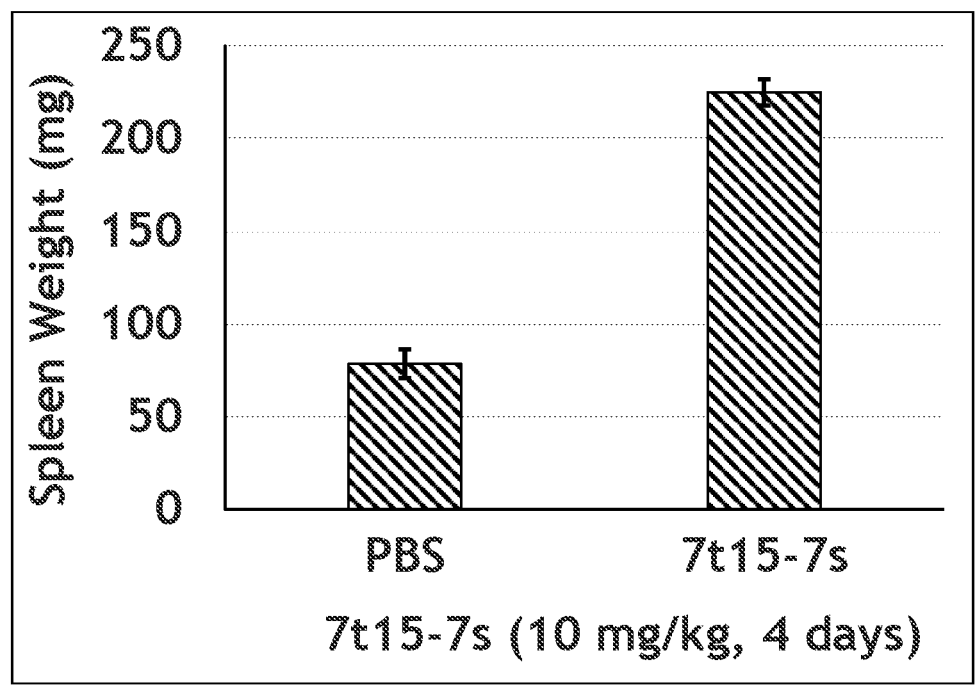
FIGS. 94A and 94B show spleen weight and the percentages of immune cell types in 7t15-7s-treated and control-treated mice.
Figure 94B:
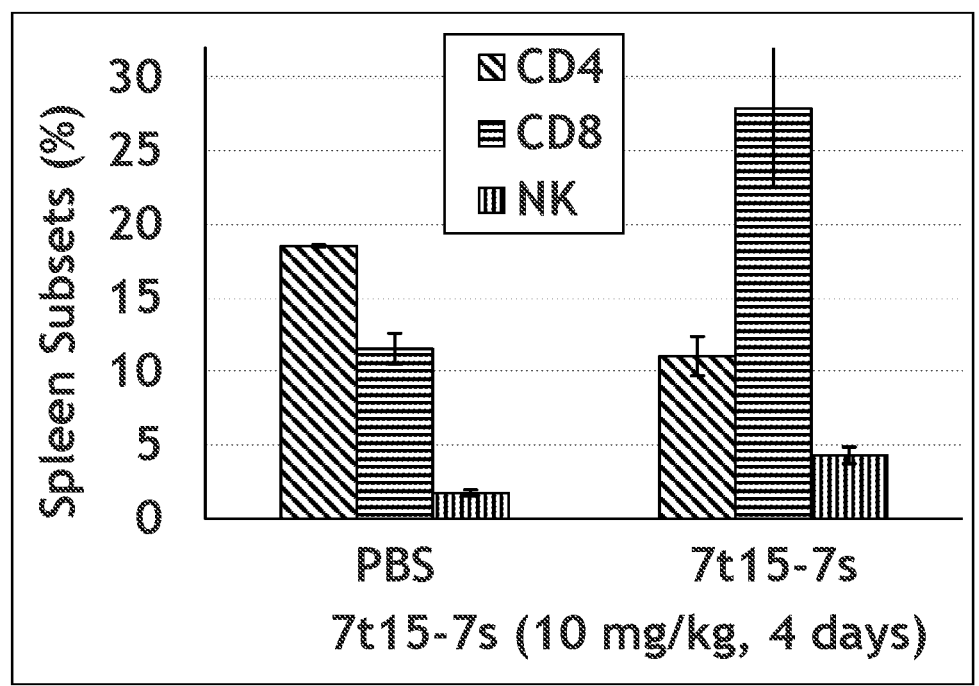

7t15-7s was subcutaneously injected into C57BL/6 mice at 10 mg/kg to determine the immunostimulatory activity of 7t15-7s in vivo. C57BL/6 mice subcutaneously treated with PBS were used as control. The mouse spleens were collected and weighed day 4 post treatment. Single splenocytes suspensions were prepared, and with fluorochrome-conjugated anti-CD4, anti-CD8, and anti-NK1.1 antibodies and the percentage of CD4+ T cells, CD8+ T cells, and NK cells was analyzed by flow cytometry. The results showed that 7t15-7s was effective at expanding splenocytes based on spleen weight (FIG. 94A) and specifically, the percentages of CD8+ T cells and NK cells were higher compared to control-treated mice (FIG. 94B).

Example 53: TGFRt15-TGFRs Fusion Protein Generation and Characterization

Figure 95:
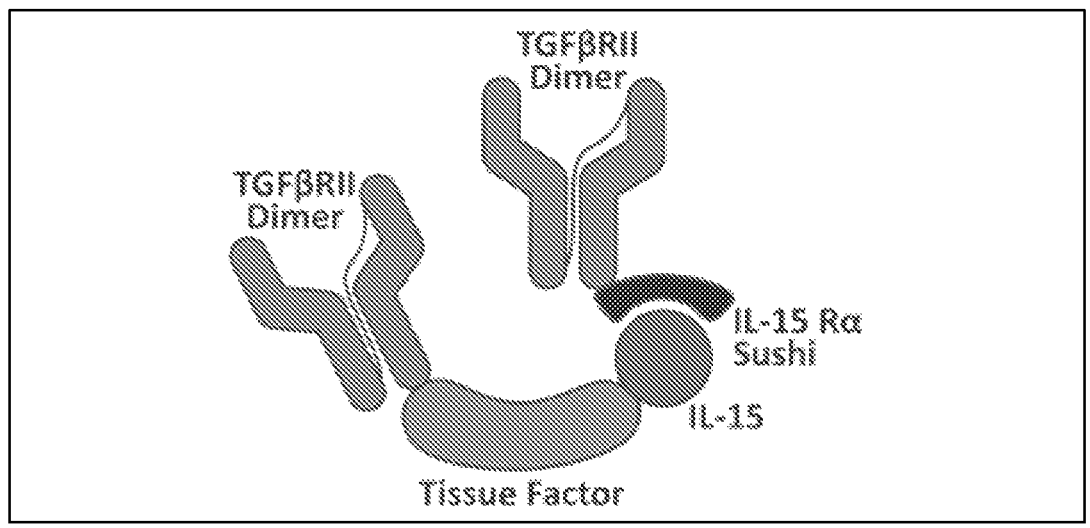
FIG. 95 shows a schematic of the TGFRt15-TGFRs construct.
Figure 96:
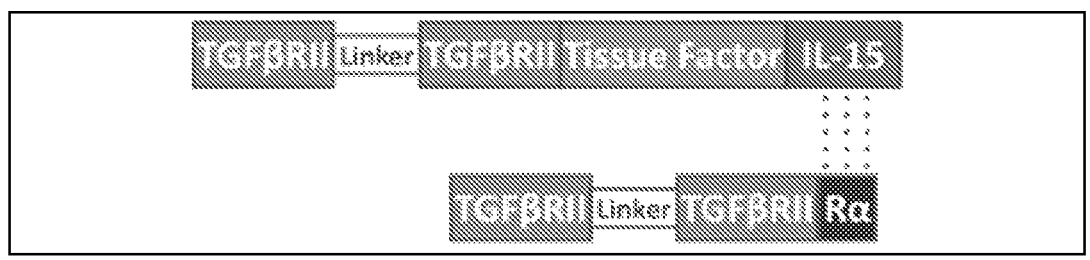
FIG. 96 shows an additional schematic of the TGFRt15-TGFRs construct.
Figure 97:
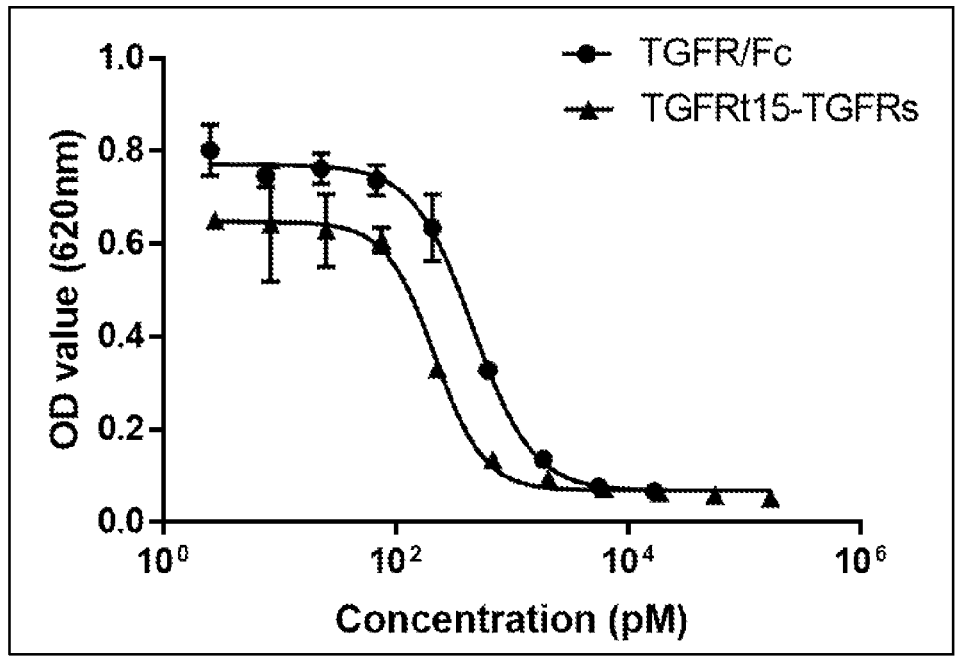
FIG. 97 shows results of TGFβ1 inhibition by TGFRt15-TGFRs and TGFR-Fc.
Figure 98:
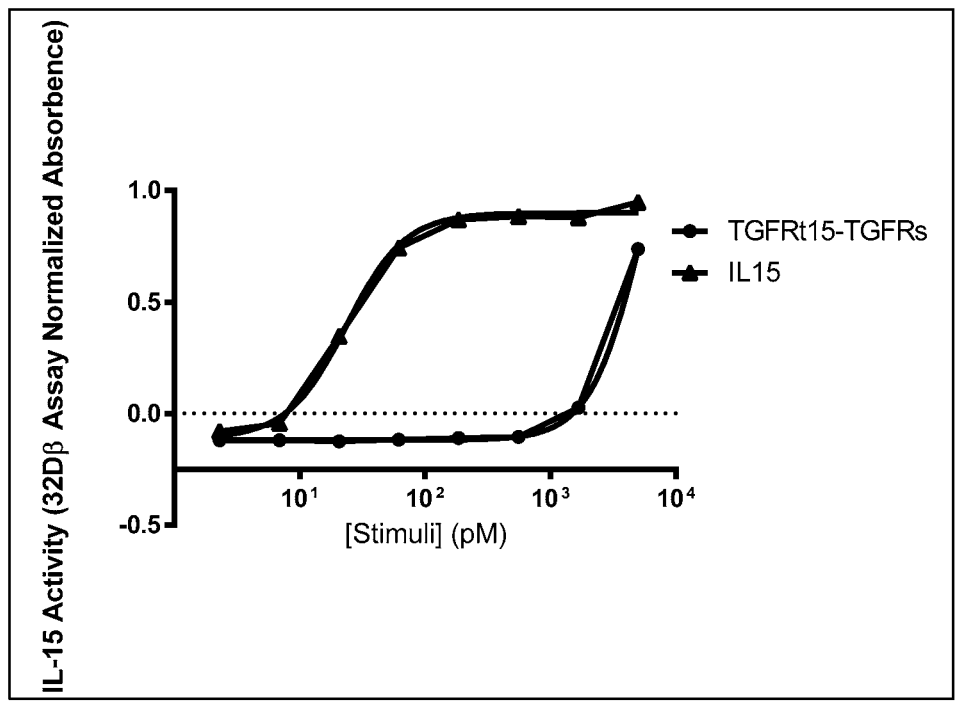
FIG. 98 shows results of 32DP cell proliferation assay with TGFRt15-TGFRs or recombinant IL-15
Figure 99A:
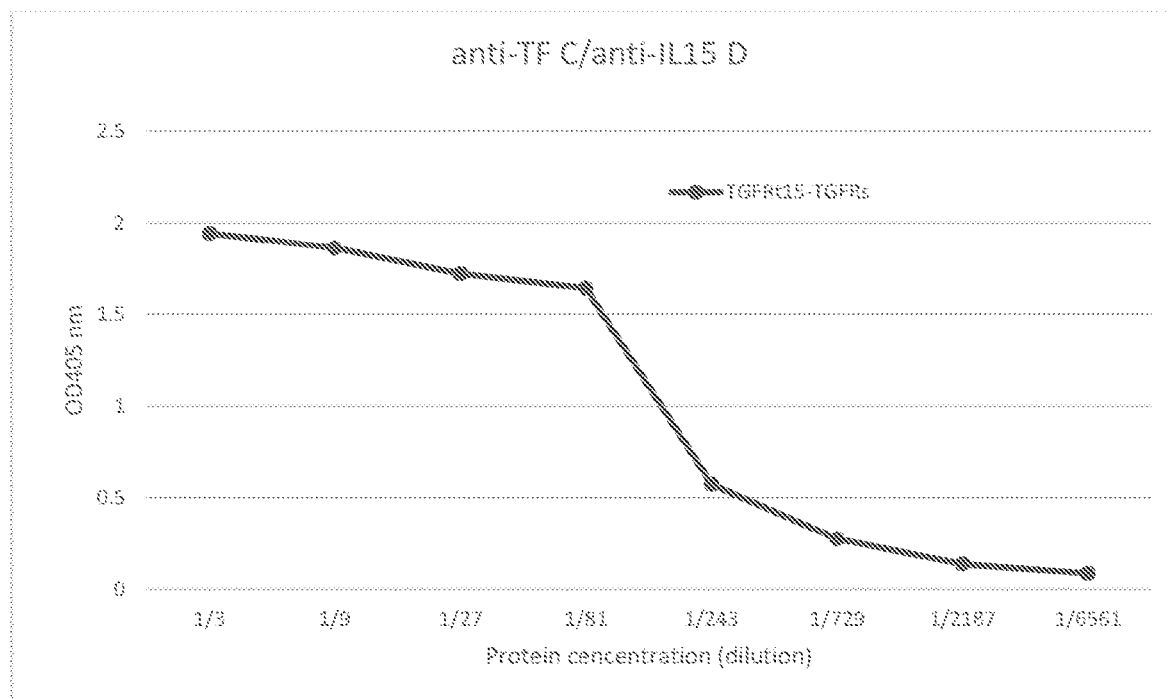
FIGS. 99A and 99B show results of detecting IL-15 and TGFβRII in TGFRt15-TGFRs with corresponding antibodies using ELISA.
Figure 99B:
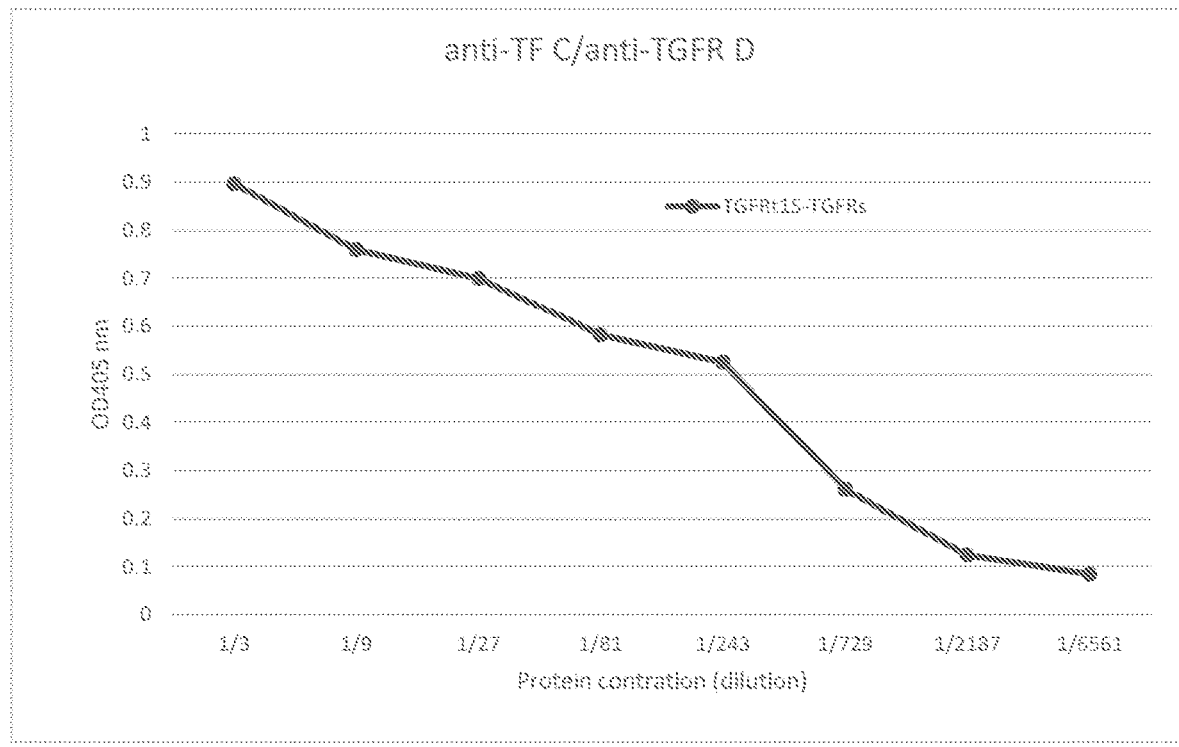
Figure 100:
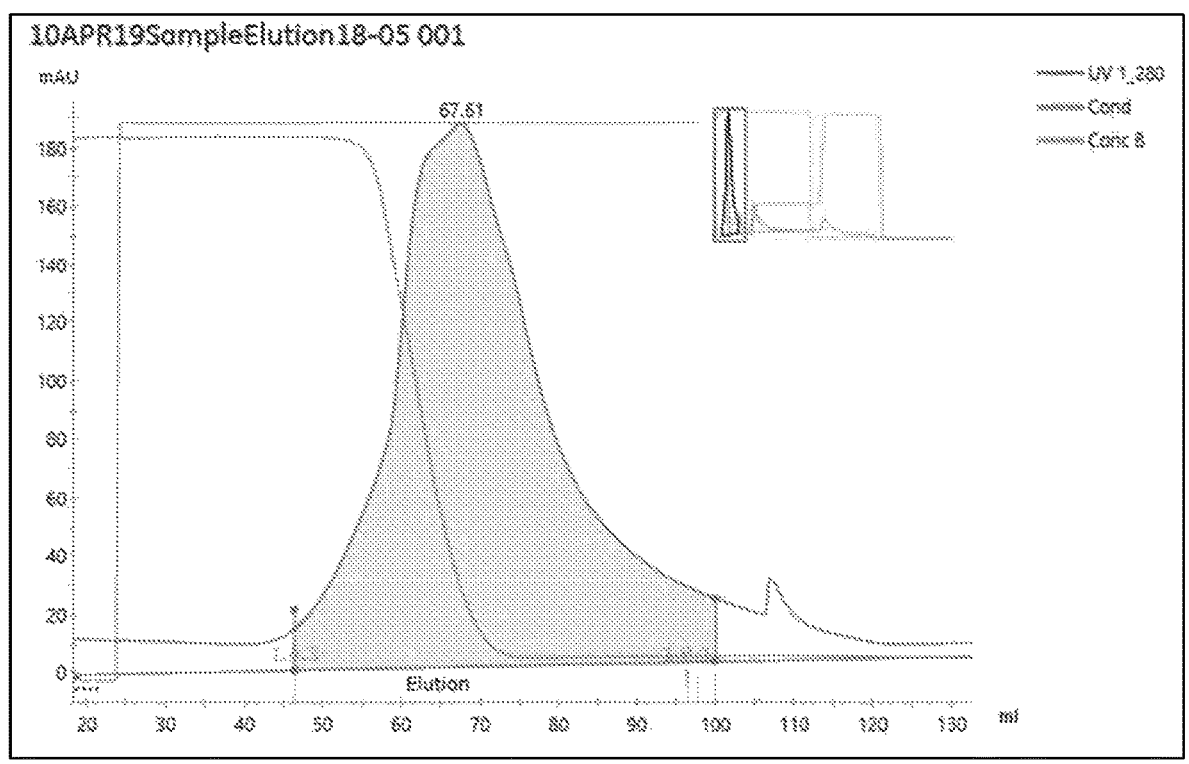
FIG. 100 is a line graph showing the chromatographic profile of TGFRt15-TGFRs protein containing cell culture supernatant following binding and elution on anti-TF antibody resin.
Figure 101:
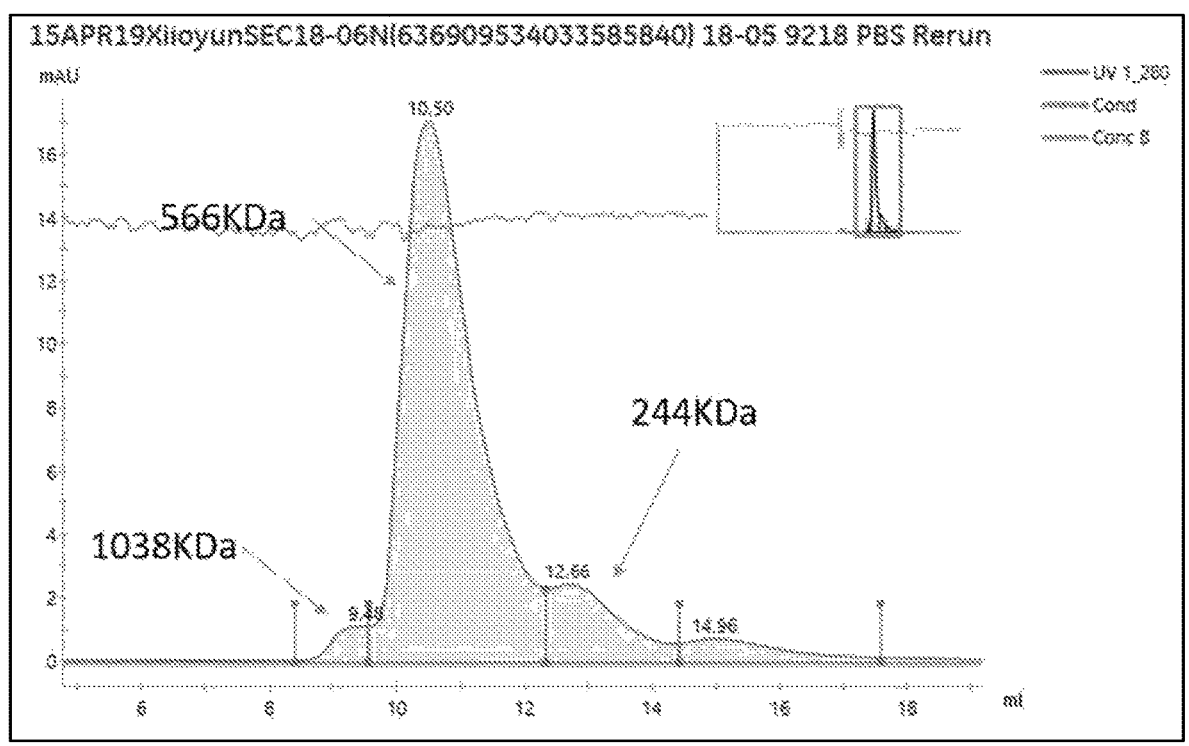
FIG. 101 shows the analytical SEC profile of TGFRt15-TGFRs.

A fusion protein complex was generated comprising of TGFβ Receptor II/IL-15RαSu and TGFβ Receptor II/TF/IL-15 fusion proteins (FIG. 95 and FIG. 96). The human TGFβ Receptor II (Ile24-Asp159), tissue factor 219, and IL-15 sequences were obtained from the UniProt website and DNA for these sequences was synthesized by Genewiz. Specifically, a construct was made linking two TGFβ Receptor II sequences with a G4S(3) linker to generate a single chain version of TGFβ Receptor II and then directly linking to the N-terminus coding region of tissue factor 219 followed by the N-terminus coding region of IL-15.

The nucleic acid and protein sequences of a construct comprising two TGFβ Receptor II linked to the N-terminus of tissue factor 219 following with the N-terminus of IL-15 are shown below.

The nucleic acid sequence of the two TGF Receptor II/TF/IL-15 construct (including signal peptide sequence) is as follows:

(Signal peptide)
ATGAAGTGGGTGACCTTCATCAGCCTGCTGTTCCTGTTCTCCAGCGCCT

ACTCC (Two Human TGFβ Receptor II fragments)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCAGCA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG

CAACCCTGATGGAGGTGGCGGATCCGGAGGTGGAGGTTCTGGTGGAGGTG

GGAGTATTCCTCCCCACGTGCAGAAGAGCGTGAATAATGACATGATCGTG

ACCGATAACAATGGCGCCGTGAAATTTCCCCAGCTGTGCAAATTCTGCGA

TGTGAGGTTTTCCACCTGCGACAACCAGAAGTCCTGTATGAGCAACTGCT

```
-continued
CCATCACCTCCATCTGTGAGAAGCCTCAGGAGGTGTGCGTGGCTGTCTGG

CGGAAGAATGACGAGAATATCACCCTGGAAACCGTCTGCCACGATCCCAA

GCTGCCCTACCACGATTTCATCCTGGAAGACGCCGCCAGCCCTAAGTGCA

TCATGAAAGAGAAAAAGAAGCCTGGCGAGACCTTTTTCATGTGCTCCTGC

AGCAGCGACGAATGCAACGACAATATCATCTTTAGCGAGGAATACAATAC

CAGCAACCCCGAC (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC
```

The amino acid sequence of TGFβ. Receptor II/TF/IL-15 fusion protein (including the leader sequence) is as follows:

```
(Signal peptide)
MKWVTFISLLFLFSSAYS (Human TGFβ Receptor II)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS
```

Constructs were also made by attaching two TGFβ Receptor II directly to the IL-15RαSu chain which was synthesized by Genewiz. The nucleic acid and protein sequences of a construct comprising the TGFβ Receptor II linked to the N-terminus of IL-15RαSu are shown below.

The nucleic acid sequence of the TGFβ Receptor II/IL-15 RαSu construct (including signal peptide sequence) is as follows:

```
(Signal peptide)
ATGAAGTGGGTGACCTTCATCAGCCTGCTGTTCCTGTTCTCCAGCGCCT

ACTCC (Two human TGFβ Receptor II fragments)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCAGCA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG

CAACCCTGATGGAGGTGGCGGATCCGGAGGTGGAGGTTCTGGTGGAGGTG

GGAGTATTCCTCCCCACGTGCAGAAGAGCGTGAATAATGACATGATCGTG

ACCGATAACAATGGCGCCGTGAAATTTCCCCAGCTGTGCAAATTCTGCGA

TGTGAGGTTTTCCACCTGCGACAACCAGAAGTCCTGTATGAGCAACTGCT

CCATCACCTCCATCTGTGAGAAGCCTCAGGAGGTGTGCGTGGCTGTCTGG

CGGAAGAATGACGAGAATATCACCCTGGAAACCGTCTGCCACGATCCCAA

GCTGCCCTACCACGATTTCATCCTGGAAGACGCCGCCAGCCCTAAGTGCA

TCATGAAAGAGAAAAAGAAGCCTGGCGAGACCTTTTTCATGTGCTCCTGC

AGCAGCGACGAATGCAACGACAATATCATCTTTAGCGAGGAATACAATAC

CAGCAACCCCGAC (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG
```

The amino acid sequence of the two TGFβ Receptor II/IL-15RαSu construct (including signal peptide sequence) is as follows:

(Signal peptide)
MKWVTFISLLFLFSSAYS (Two human TGFβ Receptor II extra-cellular domains)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD (Human IL-15R α sushi domain)
ITCPPPM gel) electrophoresis (SDS-PAGE) method under reduced condition. After electrophoresis, the gel was stained with InstantBlue for about 30 min, followed by destaining overnight in purified water.

Figure 102:
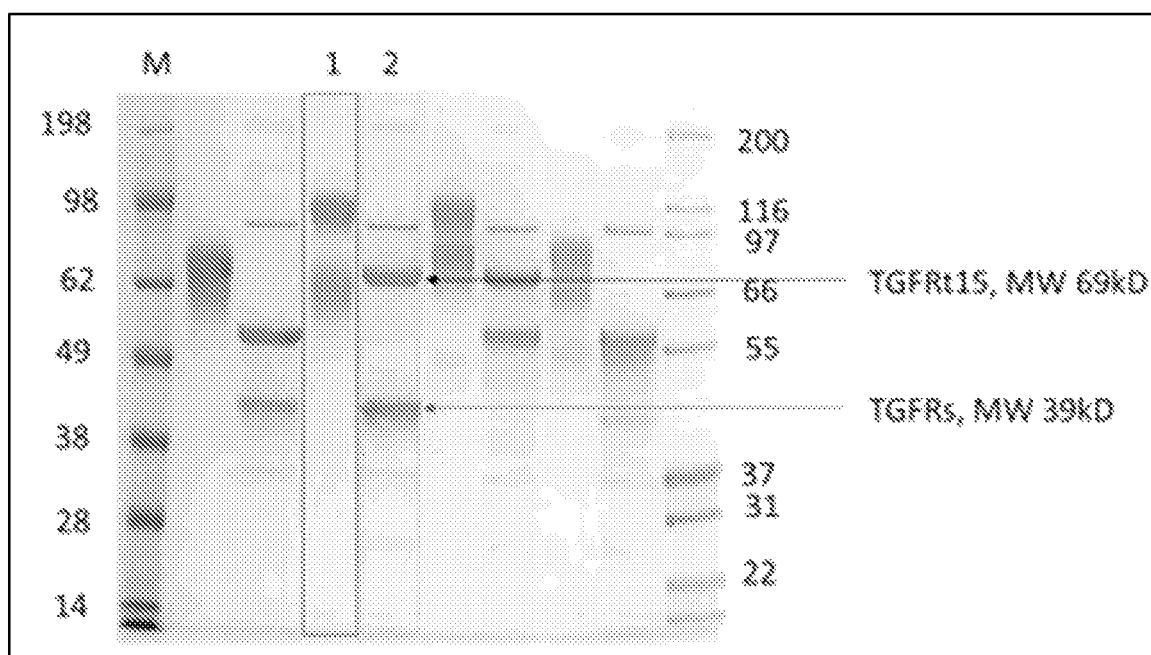
FIG. 102 shows TGFRt15-TGFRs before and after deglycosylation as analyzed by reduced SDS-PAGE.

To verify that the TGFRt15-TGFRs protein undergoes glycosylation after translation in CHO cells, a deglycosylation experiment was conducted using the Protein Deglycosylation Mix II kit from New England Biolabs and the manufacturer's instructions. FIG. 102 shows the reduced SDS-PAGE analysis of the sample in non-deglycosylated (lane 1) and deglycosylated (lane 2) state. The results showed that the TGFRt15-TGFRs protein is glycosylated when expressed in CHO cells. After deglycosylation, the purified sample showed expected molecular weights (69 kDa and 39 kDa) in the reduced SDS gel. Lane M was loaded with 10 ul of SeeBlue Plus2 Prestained Standard.

Immunostimulatory Activity of TGFRt15-TGFRs in C57BL/6 Mice

TGFRt15-TGFRs is a multi-chain polypeptide (a type A multi-chain polypeptide described herein) that includes a first polypeptide that is a soluble fusion of two TGFβRII domains, human tissue factor 219 fragment and human IL-15, and the second polypeptide that is a soluble fusion of two TGFβRII domains and sushi domain of human IL-15 receptor alpha chain.

Figure 103A:
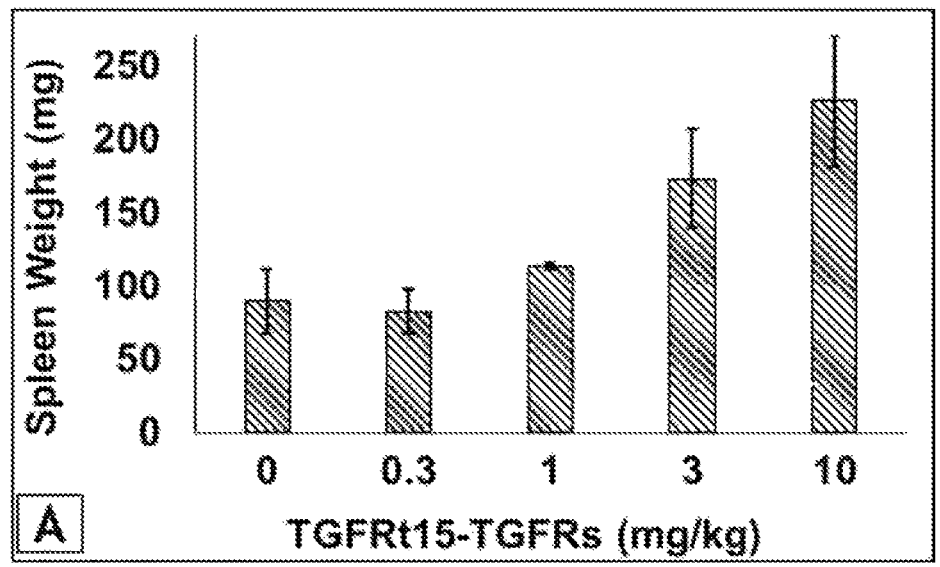
FIGS. 103A and 103B show spleen weight and the percentages of immune cell types in TGFRt15-TGFRs-treated and control-treated mice.
Figure 103B:
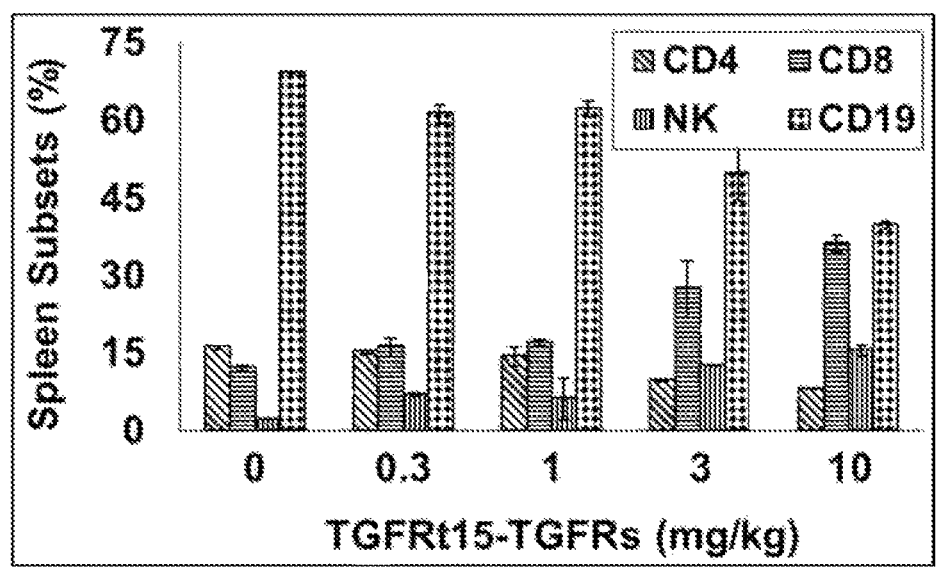

Wild type C57BL/6 mice were treated subcutaneously with either control solution or with TGFRt15-TGFRs at a dosage of 0.3 mg/kg, 1 mg/kg, 3 mg/kg, or 10 mg/kg. Four days after treatment, spleen weight and the percentages of various immune cell types present in the spleen were evaluated. As shown in FIG. 103A, the spleen weight in mice treated with TGFRt15-TGFRs increased with increasing dosage of TGFRt15-TGFRs. Moreover, the spleen weight in mice treated with 1 mg/kg, 3 mg/kg, and 10 mg/kg of TGFRt15-TGFRs were higher as compared to mice treated with the control solution, respectively. In addition, the percentages of $CD4^+$ T cells, $CD8^+$ T cells, NK cells, and $CD19^+$ B cells present in the spleen of control-treated and TGFRt15-TGFRs-treated mice were evaluated. As shown in FIG. 103B, in the spleens of mice treated with TGFRt15-TGFRs, the percentages of $CD8^+$ T cells and NK cells both increased with increasing dosage of TGFRt15-TGFRs. Specifically, the percentages of $CD8^+$ T cells were higher in mice treated with 0.3 mg/kg, 3 mg/kg, and 10 mg/kg of TGFRt15-TGFRs compared to control-treated mice, and the percentages of NK cells were higher in mice treated with 0.3 mg/kg, 1 mg/kg, 3 mg/kg, and 10 mg/kg of TGFRt15-TGFRs compared to control-treated mice. These results demonstrate that TGFRt15-TGFRs is able to stimulate immune cells in the spleen, in particular $CD8^+$ T cells and NK cells.

The pharmacokinetics of TGFRt15-TGFRs molecules were evaluated in wild type C57BL/6 mice. The mice were treated subcutaneously with TGFRt15-TGFRs at a dosage of 3 mg/kg. The mouse blood was drained from tail vein at various time points and the serum was prepared. The TGFRt15-TGFRs concentrations in mouse serum was determined with ELISA (capture: anti-human tissue factor antibody; detection: biotinylated anti-human TGFβ receptor antibody and followed by peroxidase conjugated streptavidin and ABTS substrate). The results showed that the half-life of TGFRt15-TGFRs was 12.66 hours in C57BL/6 mice.

Figure 104A:
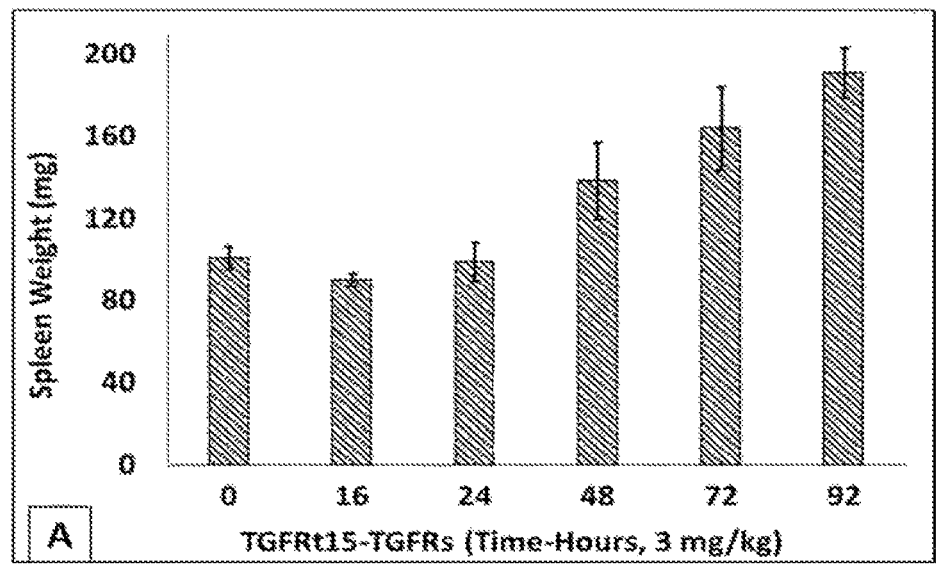
FIGS. 104A and 104B show the spleen weight and immunostimulation over 92 hours in mice treated with TGFRt15-TGFRs.
Figure 104B:
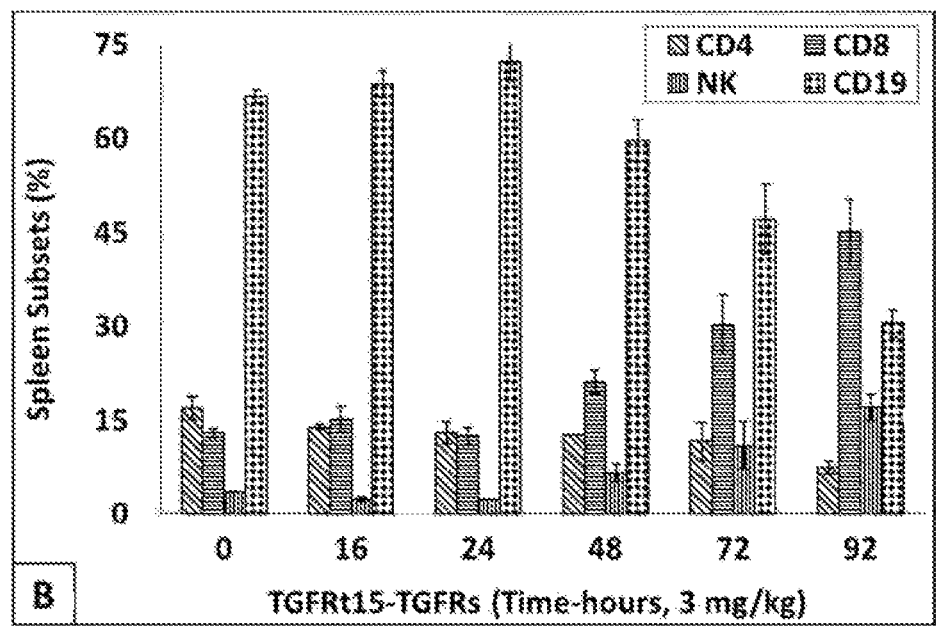

The mouse splenocytes were prepared in order to evaluate the immunostimulatory activity of TGFRt15-TGFRs over time in mice. As shown in FIG. 104A, the spleen weight in mice treated with TGFRt15-TGFRs increased 48 hours posttreatment and continued to increase over time. In addition, the percentages of $CD4^+$ T cells, $CD8^+$ T cells, NK cells, and $CD19^+$ B cells present in the spleen of control-treated and TGFRt15-TGFRs-treated mice were evaluated. As shown in FIG. 104B, in the spleens of mice treated with TGFRt15-TGFRs, the percentages of $CD8^+$ T cells and NK cells both increased at 48 hours after treatment and were higher and higher overtime after the single dose treatment. These results further demonstrate that TGFRt15-TGFRs is able to stimulate immune cells in the spleen, in particular $CD8^+$ T cells and NK cells.

Figure 105A:
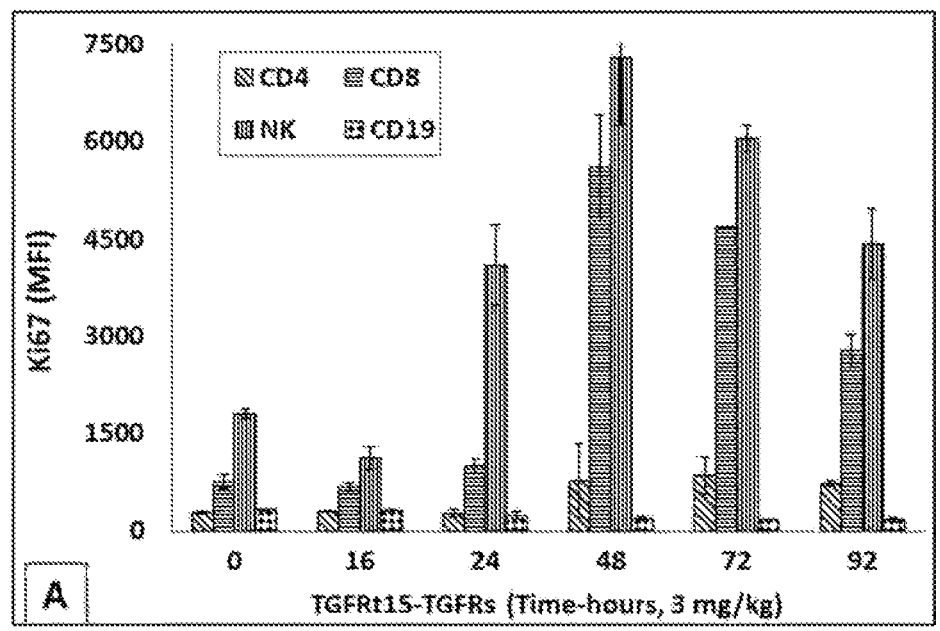
FIGS. 105A and 105B show Ki67 and Granzyme B expression in mice treated with TGFRt15-TGFRs over time.
Figure 105B:
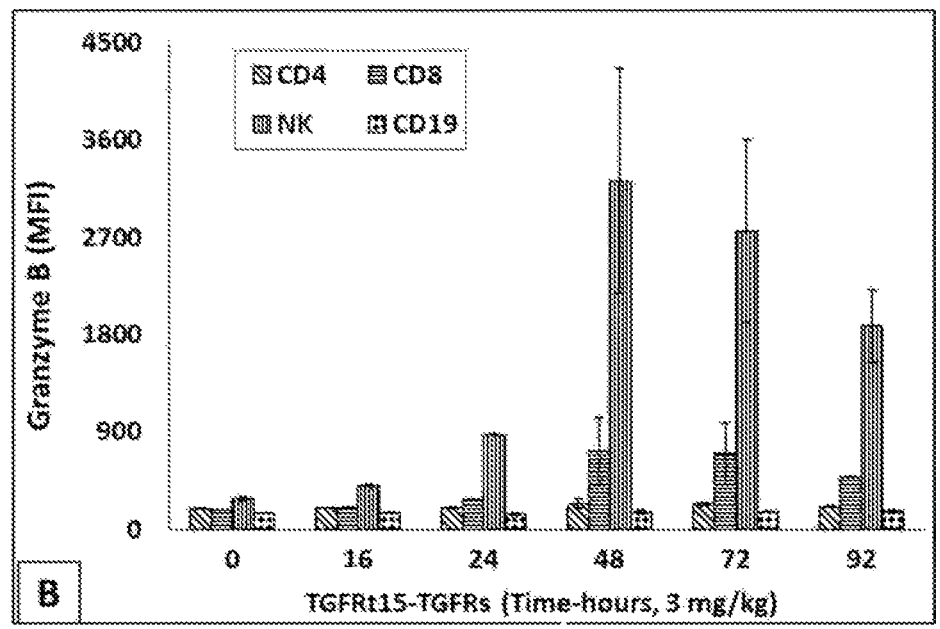

Furthermore, the dynamic proliferation of immune cells based on Ki67 expression of splenocytes and cytotoxicity potential based on granzyme B expression were evaluated in splenocytes isolated from mice following a single dose (3 mg/kg) of TGFRt15-TGFRs. As shown in FIGS. 105A and 105B, in the spleens of mice treated with TGFRt15-TGFRs, the expression of Ki67 and granzyme B by NK cells increased at 24 hours after treatment and its expression of $CD8^+$ T cells and NK cells both increased at 48 hours and later time points after the single dose treatment. These results demonstrate that TGFRt15-TGFRs not only increases the numbers of $CD8^+$ T cells and NK cells but also enhance the cytotoxicity of these cells. The single dose treatment of TGFRt15-TGFRs led $CD8^+$ T cells and NK cells to proliferate for at least 4 days.

Figure 106:
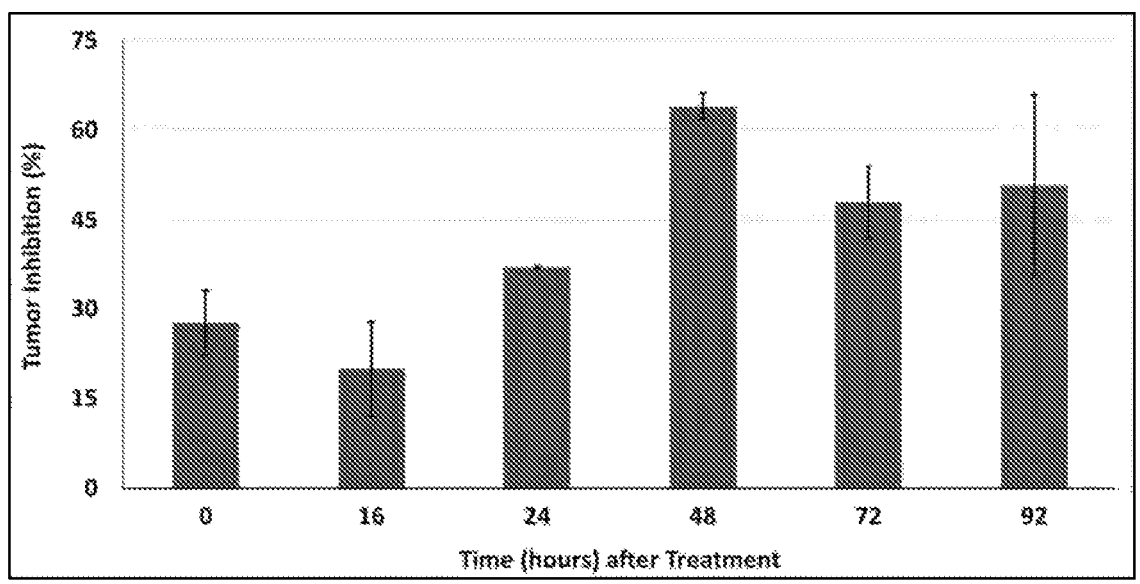
FIG. 106 shows enhancement of cytotoxicity of splenocytes by TGFRt15-TGFRs in C57BL/6 Mice.

The cytotoxicity of the splenocytes from TGFRt15-TGFRs-treated mice against tumor cells was also evaluated. Mouse Moloney leukemia cells (Yac-1) were labeled with CellTrace Violet and were used as tumor target cells. Splenocytes were prepared from TGFRt15-TGFRs (3 mg/kg)-treated mouse spleens at various time points post treatment and were used as effector cells. The target cells were mixed with effector cells at an E:T ratio=10:1 and incubated at 37° C. for 20 hours. Target cell viability was assessed by analysis of propidium iodide positive, CellTrace Violet-labeled Yac-1 cells using flow cytometry. Percentage of Yac-1 tumor inhibition was calculated using the formula, (1−[viable Yac-1 cell number in experimental sample]/[viable Yac-1 cell number in the sample without splenocytes])×100. As shown in FIG. 106, splenocytes from TGFRt15-TGFRs-treated mice had stronger cytotoxicity against Yac-1 cells than the control mouse splenocytes.

Tumor Size Analysis in Response to Chemotherapy and/or TGFRt15-TGFRs

Figure 107:
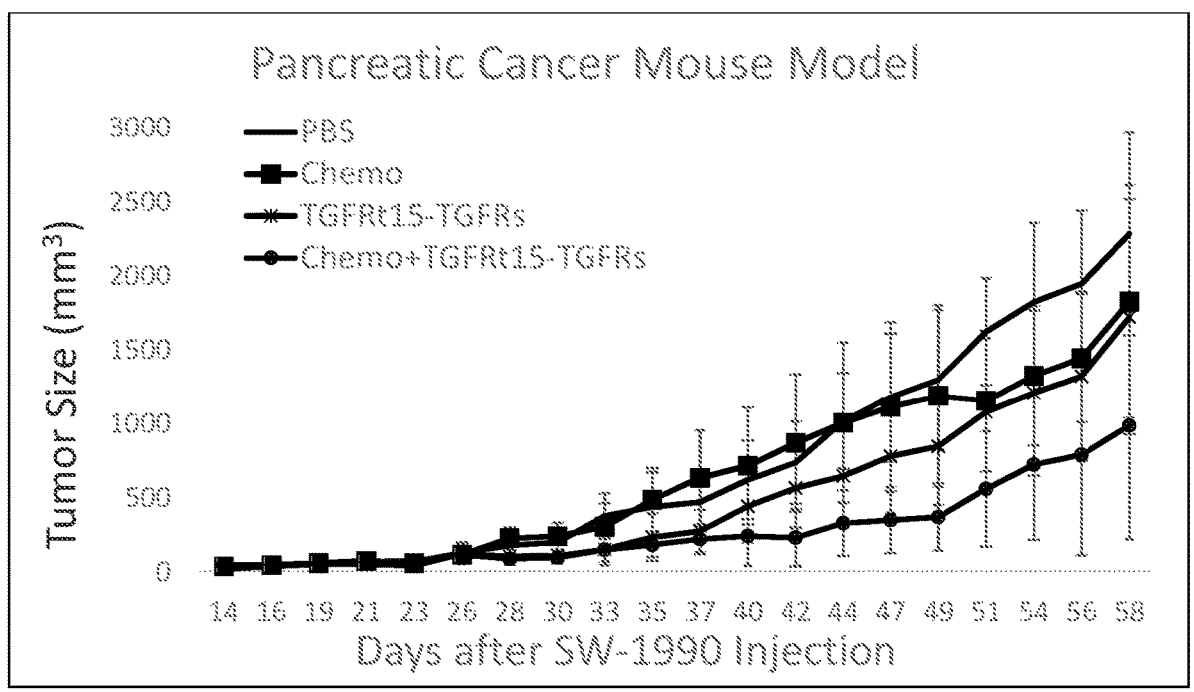
FIG. 107 shows changes in tumor size in response to PBS treatment, chemotherapy alone, TGFRt15-TGFRs alone, or chemotherapy and TGFRt15-TGFRs combination, in a pancreatic cancer mouse model.

Pancreatic cancer cells (SW1990, ATCC® CRL-2172) were subcutaneously (s.c.) injected into C57BL/6 scid mice (The Jackson Laboratory, 001913, $2\times10^6$ cells/mouse, in 100 μL HBSS) to establish the pancreatic cancer mouse model. Two weeks after tumor cell injection, chemotherapy was initiated in these mice intraperitoneally with a combination of Abraxane (Celgene, 68817-134, 5 mg/kg, i.p.) and Gemcitabine (Sigma Aldrich, G6423, 40 mg/kg, i.p.), followed by immunotherapy with TGFRt15-TGFRs (3 mg/kg, s.c.) in 2 days. The procedure above was considered one treatment cycle and was repeated for another 3 cycles (1 cycle/week). Control groups were set up as the SW1990-injected mice that received PBS, chemotherapy (Gemcitabine and Abraxane), or TGFRt15-TGFRs alone. Along with the treatment cycles, tumor size of each animal was measured and recorded every other day, until the termination of the experiment 2 months after the SW1990 cells were injected. Measurement of the tumor volumes were analyzed by group and the results indicated that the animals receiving a combination of chemotherapy and TGFRt15-TGFRs had significantly smaller tumors comparing to the PBS group, whereas neither chemotherapy nor TGFRt15-TGFRs therapy alone work as sufficiently as the combination (FIG. 107).

In Vitro Senescent B16F10 Melanoma Model

Figure 108:
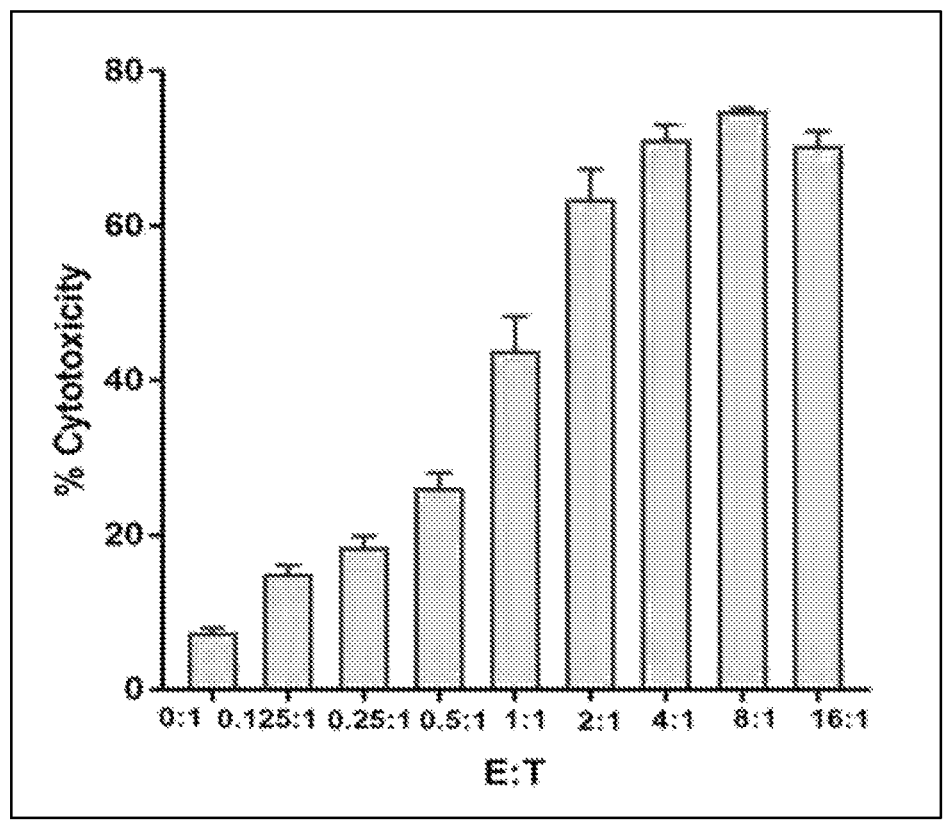
FIG. 108 shows the cytotoxicity of NK cells isolated from mice treated with TGFRt15-TGFRs.

Next, in vitro killing of senescent B16F10 melanoma cells by activated mouse NK cells was evaluated. B16F10 senescence cells (B16F10-SNC) cells were labelled with Cell-Trace Violet and incubated for 16 hrs with different E:T ratio of in vitro 2t2-activated mouse NK cells (isolated from spleen of C57BL/6 mice injected with TGFRt15-TGFRs10 mg/kg for 4 days). The cells were trypsinized, washed and resuspended in complete media containing propidium iodide (PI) solution. The cytotoxicity was assessed by flow cytometry (FIG. 108).

Figure 109:
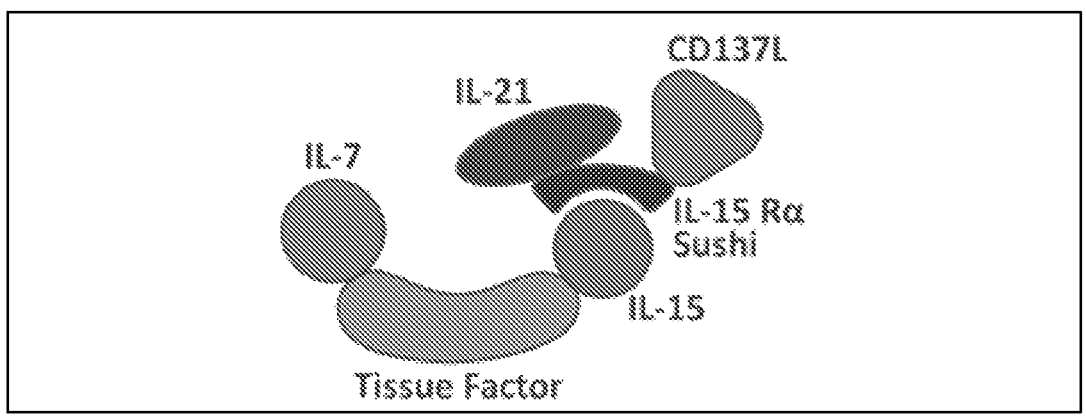
FIG. 109 shows a schematic of the 7t15-21s137L (long version) construct.
Figure 110:
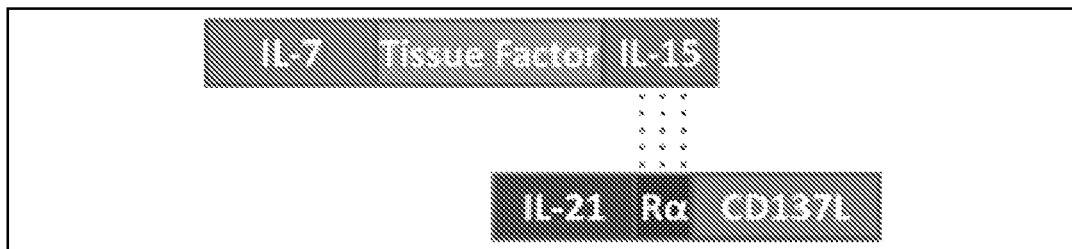
FIG. 110 shows an additional schematic of the 7t15-21s137L (long version) construct.

Example 54: 7t15-21s137L (Long Version) Fusion Protein Creation and Characterization A fusion protein complex was generated comprising of IL-21/IL-15RαSu/CD137L and IL-7/TF/IL-15 fusion proteins (FIG. 109 and FIG. 110). Specifically, a construct was made linking the IL-7 sequence to the N-terminus coding region of tissue factor 219 followed by the N-terminus coding region of IL-15. The nucleic acid and protein sequences of a construct comprising IL-7 linked to the N-terminus of tissue factor 219 following with the N-terminus of IL-15 are shown below.

The nucleic acid sequence of the 7t15 construct (including signal peptide sequence) is as follows:

```
(Signal peptide)
ATGAAGTGGGTGACCTTCATCAGCCTGCTGTTCCTGTTCTCCAGCGCCT

ACTCC (Human IL7)
GATTGCGACATCGAGGGCAAGGACGGCAAGCAGTACGAGAGCGTGCT

GATGGTGTCCATCGACCAGCTGCTGGACAGCATGAAGGAGATCGGCTCCA

ACTGCCTCAACAACGAGTTCAACTTCTTCAAGCGGCACATCTGCGACGCC

AACAAGGAGGGCATGTTCCTGTTCAGGGCCGCCAGGAAACTGCGGCAGTT

CCTGAAGATGAACTCCACCGGCGACTTCGACCTGCACCTGCTGAAGGTGT

CCGAGGGCACCACCATCCTGCTGAACTGCACCGGACAGGTGAAGGGCCGG

AAACCTGCTGCTCTGGGAGAGGCCCAACCCACCAAGAGCCTGGAGGAGAA

CAAGTCCCTGAAGGAGCAGAAGAAGCTGAACGACCTGTGCTTCCTGAAGA

GGCTGCTGCAGGAGATCAAGACCTGCTGGAACAAGATCCTGATGGGCACC

AAGGAGCAT (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC
```

The amino acid sequence of 7t15 fusion protein (including the leader sequence) is as follows:

```
(Signal peptide)
MKWVTFISLLFLFSSAYS (Human IL7)
DCDIEGKDGKQYESVLMVSIDQLLDSMKEIGSNCLNNEFNFFKRHICDA
NKEGMFLFRAARKLRQFLKMNSTGDFDLHLLKVSEGTTILLNCTGQVKG
RKPAALGEAQPTKSLEENKSLKEQKKLNDLCFLKRLLQEIKTCWNKILM
GTKEH (Human Tissue Factor 219)
SGTTNTVAAYNLTWKSTNFKTILEWEPKPVNQVYTVQISTKSGDWKSKC
FYTTDTECDLTDEIVKDVKQTYLARVFSYPAGNVESTGSAGEPLYENSP
EFTPYLETNLGQPTIQSFEQVGTKVNVTVEDERTLVRRNNTFLSLRDVF
GKDLIYTLYYWKSSSSGKKTAKTNTNEFLIDVDKGENYCFSVQAVIPSR
TVNRKSTDSPVECMGQEKGEFRE (Human IL-15)
NWVNVISDLKKIEDLIQSMHIDATLYTESDVHPSCKVTAMKCFLLELQV
ISLESGDASIHDTVENLIILANNSLSSNGNVTESGCKECEELEEKNIKE
FLQSFVHIVQMFINTS
```

The nucleic acid and protein sequences of the 21s137L are shown below. The nucleic acid sequence of the 21s137L construct (including signal peptide sequence) is as follows:

```
(Signal peptide)
ATGAAGTGGGTGACCTTCATCAGCCTGCTGTTCCTGTTCTCCAGCGCCT

ACTCC (Human IL-21)
CAGGGCCAGGACAGGCACATGATCCGGATGAGGCAGCTCATCGACAT

CGTCGACCAGCTGAAGAACTACGTGAACGACCTGGTGCCCGAGTTTCTGC

CTGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGAT

CATCAACGTGAGCATCAAGAAGCTGAAGCGGAAGCCTCCCTCCACAAACG

CCGGCAGGAGGCAGAAGCACAGGCTGACCTGCCCCAGCTGTGACTCCTAC

GAGAAGAAGCCCCCCAAGGAGTTCCTGGAGAGGTTCAAGTCCCTGCTGCA
```

```
GAAGATGATCCATCAGCACCTGTCCTCCAGGACCCACGGCTCCGAGGACT

CC (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG ((G4S)3 linker)
GGCGGTGGAGGATCCGGAGGAGGTGGCTCCGGCGGCGGAGGATCT (Human CD137L)
CGCGAGGGTCCCGAGCTTTCGCCCGACGATCCCGCCGGCCTCTTGGAC

CTGCGGCAGGGCATGTTTGCGCAGCTGGTGGCCCAAAATGTTCTGCTGAT

CGATGGGCCCCTGAGCTGGTACAGTGACCCAGGCCTGGCAGGCGTGTCCC

TGACGGGGGCCTGAGCTACAAAGAGGACACGAAGGAGCTGGTGGTGGCC

AAGGCTGGAGTCTACTATGTCTTCTTTCAACTAGAGCTGCGGCGCGTGGT

GGCCGGCGAGGGCTCAGGCTCCGTTTCACTTGCGCTGCACCTGCAGCCAC

TGCGCTCTGCTGCTGGGGCCGCCGCCCTGGCTTTGACCGTGGACCTGCCA

CCCGCCTCCTCCGAGGCTCGGAACTCGGCCTTCGGTTTCCAGGGCCGCTT

GCTGCACCTGAGTGCCGGCCAGCGCCTGGGCGTCCATCTTCACACTGAGG

CCAGGGCACGCCATGCCTGGCAGCTTACCCAGGGCGCCACAGTCTTGGGA

CTCTTCCGGGTGACCCCCGAAATCCCAGCCGGACTCCCTTCACCGAGGTC

GGAA
```

The amino acid sequence of 21s137L fusion protein (including the leader sequence) is as follows:

```
(Signal peptide)
MKWVTFISLLFLFSSAYS (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS (Human IL-15R α sushi domain)
ITCPPPMSVEHADIWVKSYSLYSRERYICNSGFKRKAGTSSLTECVLNKA

TNVAHWTTPSLKCIR ((G4S)3 linker)
GGGGSGGGGSGGGGS (Human CD137L)
REGPELSPDDPAGLLDLRQGMFAQLVAQNVLLIDGPLSWYSDPGLAGVS

LTGGLSYKEDTKELVVAKAGVYYVFFQLELRRVVAGEGSGSVSLALHLQP

LRSAAGAAALALTVDLPPASSEARNSAFGFQGRLLHLSAGQRLGVHLHTE

ARARHAWQLTQGATVLGLFRVTPEIPAGLPSPRSE
```

In some cases, the leader peptide is cleaved from the intact polypeptide to generate the mature form that may be soluble or secreted.

The IL-21/IL-15RαSu/CD137L and IL-7/TF/IL-15 constructs were cloned into a modified retrovirus expression vectors as described previously (Hughes M S, Yu Y Y, Dudley M E, Zheng Z, Robbins P F, Li Y, et al. Transfer of a TCR gene derived from a patient with a marked antitumor response conveys highly active T-cell effector functions. *Hum Gene Ther* 2005; 16:457-72), and the expression vectors were transfected into CHO-K1 cells. Co-expression of the two constructs in CHO-K1 cells allowed for formation and secretion of the soluble IL-7/TF/IL-15: IL-21/IL-15RαSu/CD137L protein complex (referred to as 7t15-21s137L), which can be purified by anti-TF antibody IgG1 affinity and other chromatography methods.

Figure 111:
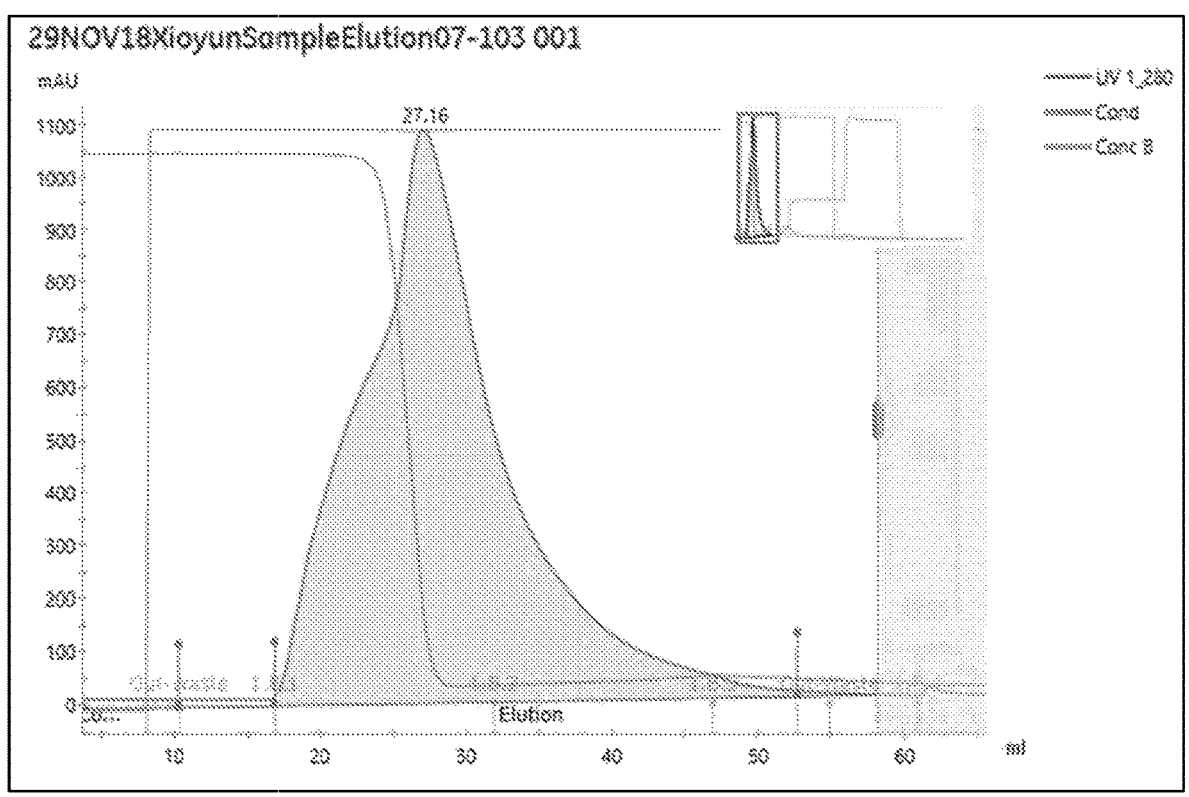
FIG. 111 is a line graph showing the chromatographic profile of 7t15-21s137L (long version) protein containing cell culture supernatant following binding and elution on anti-TF antibody resin.
Figure 112:
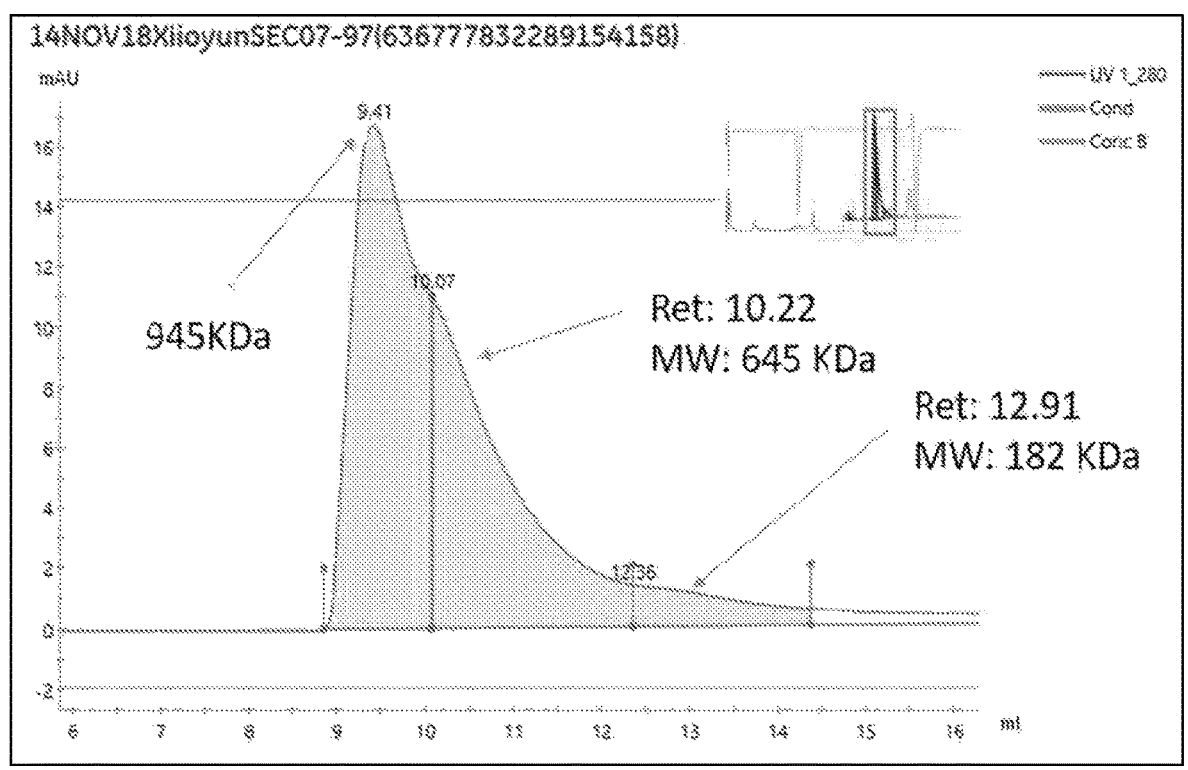
FIG. 112 shows the analytical SEC profile of 7t15-21s137L (long version).
Figure 113:
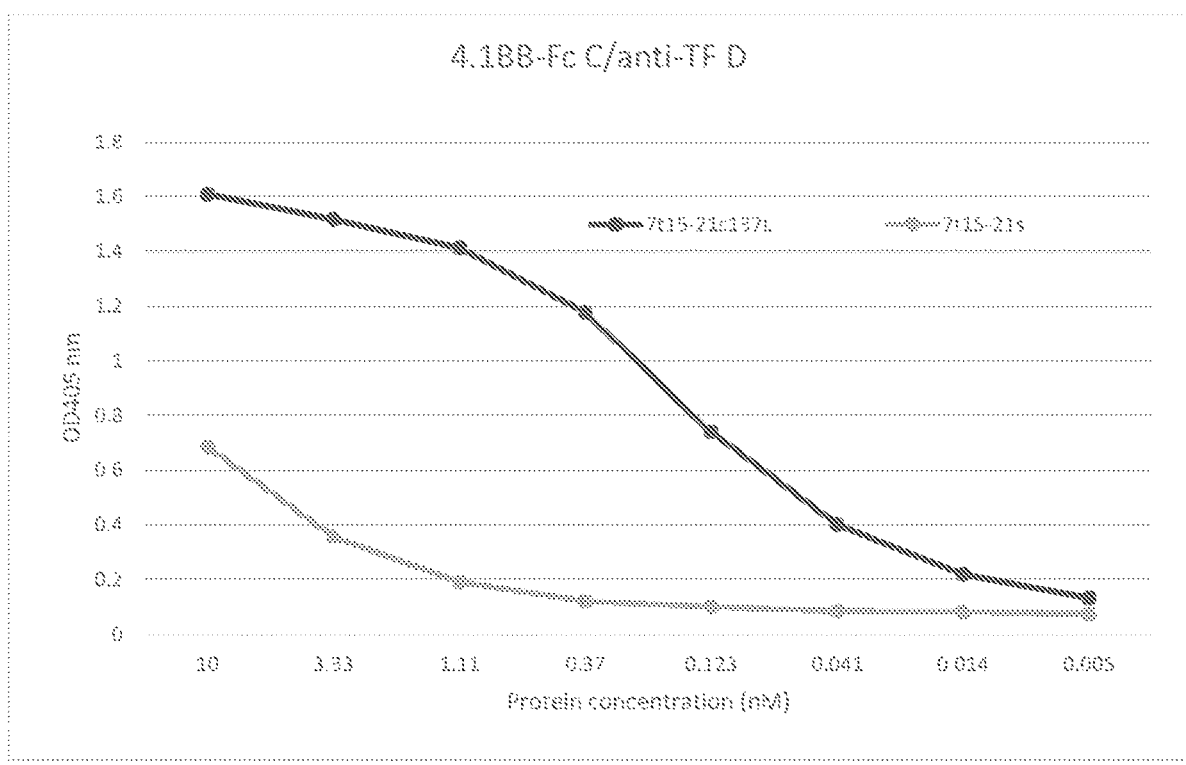
FIG. 113 shows binding of 7t15-21s137L (short version) to CD137 (4.1BBL)

Purification Elution Chromatograph of 7t15-21s137L Using Anti-TF Antibody Affinity Column 7t15-21s137L harvested from cell culture was loaded onto the anti-TF antibody affinity column equilibrated with 5 column volumes of PBS. After sample loading, the column was washed with 5 column volumes of PBS, followed by elution with 6 column volumes of 0.1M acetic acid (pH 2.9). A280 elution peak was collected and then neutralized to pH 7.5-8.0 with 1M Tris base. The neutralized sample was then buffer exchanged into PBS using Amicon centrifugal filters with a 30 KDa molecular weight cutoff. As shown in FIG. 111, the anti-TF antibody affinity column bound to 7t15-21s137L which contains TF as a fusion partner. The buffer-exchanged protein sample was stored at 2-8° C. for further biochemical analyses and biological activity tests. After each elution, the anti-TF antibody affinity column was stripped using 6 column volumes of 0.1M glycine (pH 2.5). The column was then neutralized using 5 column volumes of PBS, and 7 column volumes of 20% ethanol for storage. The anti-TF antibody affinity column was connected to a GE Healthcare AKTA Avant system. The flow rate was 4 mL/min for all steps except for the elution step, which was 2 mL/min. FIG. 112 shows the analytical SEC profile of 7t15-21s137L.

Example 55: 7t15-21s137L (Short Version) Fusion Protein Generation and Characterization A fusion protein complex was generated comprising of IL-21/IL-15RαSu/CD137L and IL-7/TF/IL-15 fusion proteins. Specifically, a construct was made linking the IL-7 sequence to the N-terminus coding region of tissue factor 219 followed by the N-terminus coding region of IL-15. The nucleic acid and protein sequences of a construct comprising IL-7 linked to the N-terminus of tissue factor 219 following with the N-terminus of IL-15 are shown below.

The nucleic acid sequence of 7t15 construct (including signal peptide sequence) is as follows:

```
(Signal peptide)
ATGAAGTGGGTGACCTTCATCAGCCTGCTGTTCCTGTTCTCCAGCGCCT

ACTCC (Human IL7)
GATTGCGACATCGAGGGCAAGGACGGCAAGCAGTACGAGAGCGTGCT

GATGGTGTCCATCGACCAGCTGCTGGACAGCATGAAGGAGATCGGCTCA

ACTGCCTCAACAACGAGTTCAACTTCTTCAAGCGGCACATCTGCGACGCC

AACAAGGAGGGCATGTTCCTGTTCAGGGCCGCCAGGAAACTGCGGCAGTT

CCTGAAGATGAACTCCACCGGCGACTTCGACCTGCACCTGCTGAAGGTGT

CCGAGGGCACCACCATCCTGCTGAACTGCACCGGACAGGTGAAGGGCCGG

AAACCTGCTGCTCTGGGAGAGGCCCAACCCACCAAGAGCCTGGAGGAGAA
```

-continued
CAAGTCCCTGAAGGAGCAGAAGAAGCTGAACGACCTGTGCTTCCTGAAGA

GGCTGCTGCAGGAGATCAAGACCTGCTGGAACAAGATCCTGATGGGCACC

AAGGAGCAT (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC

The amino acid sequence of 7t15 fusion protein (including the leader sequence) is as follows:

(Signal peptide)
MKWVTFISLLFLFSSAYS (Human IL7)
DCDIEGKDGKQYESVLMVSIDQLLDSMKEIGSNCLNNEFNFFKRHICD

ANKEGMFLFRAARKLRQFLKMNSTGDFDLHLLKVSEGTTILLNCTGQV

KGRKPAALGEAQPTKSLEENKSLKEQKKLNDLCFLKRLLQEIKTCWNK

ILMGTKEH (Human Tissue Factor 219)
SGTTNTVAAYNLTWKSTNFKTILEWEPKPVNQVYTVQISTKSGDWKSK

CFYTTDTECDLTDEIVKDVKQTYLARVFSYPAGNVESTGSAGEPLYEN

SPEFTPYLETNLGQPTIQSFEQVGTKVNVTVEDERTLVRRNNTFLSLR

DVFGKDLIYTLYYWKSSSSGKKTAKTNTNEFLIDVDKGENYCFSVQAV

IPSRTVNRKSTDSPVECMGQEKGEFRE (Human IL-15)
NWVNVISDLKKIEDLIQSMHIDATLYTESDVHPSCKVTAMKCFLLELQ

VISLESGDASIHDTVENLIILANNSLSSNGNVTESGCKECEELEEKNI

KEFLQSFVHIVQMFINTS

The nucleic acid and protein sequences of the 21s137L (short version) are shown below. The nucleic acid sequence of 21s137L (short version) construct (including signal peptide sequence) is as follows:

(Signal peptide)
ATGAAGTGGGTGACCTTCATCAGCCTGCTGTTCCTGTTCTCCAGCGCCT

ACTCC (Human IL-21)
CAGGGCCAGGACAGGCACATGATCCGGATGAGGCAGCTCATCGACAT

CGTCGACCAGCTGAAGAACTACGTGAACGACCTGGTGCCCGAGTTTCTGC

CTGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGAT

CATCAACGTGAGCATCAAGAAGCTGAAGCGGAAGCCTCCCTCCACAAACG

CCGGCAGGAGGCAGAAGCACAGGCTGACCTGCCCCAGCTGTGACTCCTAC

GAGAAGAAGCCCCCCAAGGAGTTCCTGGAGAGGTTCAAGTCCCTGCTGCA

GAAGATGATCCATCAGCACCTGTCCTCCAGGACCCACGGCTCCGAGGACT

CC (Human IL-15R α sushi domain)
ATTACATGCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG ((G4S)3 linker)
GGCGGTGGAGGATCCGGAGGAGGTGGCTCCGGCGGCGGAGGATCT (Human CD137 Ligand short version)
GATCCCGCCGGCCTCTTGGACCTGCGGCAGGGCATGTTTGCGCAGCTG

GTGGCCCAAAATGTTCTGCTGATCGATGGGCCCCTGAGCTGGTACAGTGA

CCCAGGCCTGGCAGGCGTGTCCCTGACGGGGGCCTGAGCTACAAGAGG

ACACGAAGGAGCTGGTGGTGGCCAAGGCTGGAGTCTACTATGTCTTCTTT

CAACTAGAGCTGCGGCGCGTGGTGGCCGGCGAGGGCTCAGGCTCCGTTTC

ACTTGCGCTGCACCTGCAGCCACTGCGCTCTGCTGCTGGGGCCGCCGCCC

TGGCTTTGACCGTGGACCTGCCACCCGCCTCCTCCGAGGCTCGGAACTCG

GCCTTCGGTTTCCAGGGCGCTTGCTGCACCTGAGTGCCGGCCAGCGCCT

GGGCGTCCATCTTCACACTGAGGCCAGGGCACGCCATGCCTGGCAGCTTA

CCCAGGGCGCCACAGTCTTGGGACTCTTCCGGGTGACCCCCGAAATC

The amino acid sequence of the 21s137L (short version) construct (including signal peptide sequence) is as follows:

```
(Signal peptide)
MKWVTFISLLFLFSSAYS (Human IL-21)
QGQDRHMIRMRQLIDIVDQLKNYVNDLVPEFLPAPEDVETNCEWSAFSC

FQKAQLKSANTGNNERIINVSIKKLKRKPPSTNAGRRQKHRLTCPSCDS

YEKKPPKEFLERFKSLLQKMIHQHLSSRTHGSEDS (Human IL-15R α sushi domain)
ITCPPPMSVEHADIWVKSYSLYSRERYICNSGFKRKAGTSSLTECVLNK

ATNVAHWTTPSLKCIR ((G4S)3 linker)
GGGGSGGGGSGGGGS (Human CD137 Ligand short version)
DPAGLLDLRQGMFAQLVAQNVLLIDGPLSWYSDPGLAGVSLTGGLSYKE

DTKELVVAKAGVYYVFFQLELRRVVAGEGSGSVSLALHLQPLRSAAGAA

ALALTVDLPPASSEARNSAFGFQGRLLHLSAGQRLGVHLHTEARARHAW

QLTQGATVLGLFRVTPEI
```

The IL-21/IL-15RαSu/CD137L (short version) and IL-7/TF/IL-15 constructs were cloned into a modified retrovirus expression vectors as described previously (Hughes M S, Yu Y Y, Dudley M E, Zheng Z, Robbins P F, Li Y, et al. Transfer of a TCR gene derived from a patient with a marked antitumor response conveys highly active T-cell effector functions. *Hum Gene Ther* 2005; 16:457-72), and the expression vectors were transfected into CHO-K1 cells. Co-expression of the two constructs in CHO-K1 cells allowed for formation and secretion of the soluble IL-7/TF/IL-15: IL-21/IL-15RαSu/CD137L protein complex (referred to as 7t15-21s137L (short version)), which can be purified by anti-TF antibody IgG1 affinity and other chromatography methods.

Binding of 7t15-21s137L (Short Version) to CD137 (4.1BB)

On day 1, a 96-well plate was coated with 100 µL (2.5 µg/mL) of GAH IgG Fc (G-102-C, R&D Systems) in R5 (coating buffer) or R5 only and incubated at 4° C., overnight. On day 2, the plates were washed three times and blocked with 300 µl of 1% BSA in PBS at 37° C. for 2 hrs. 10 ng/mL of 4.1BB/Fc (838-4B, R&D Systems) was added at 100 µL/well and incubated for 2 hrs at RT. After three washes, the 7t15-21s137L or 7t15-21s serially diluted at a 1/3 ratio (starting at 10 nM), and incubated at 4° C. overnight. On day 3, following 3 washes, 300 ng/mL of biotinylated-anti-hTF antibody (BAF2339, R&D Systems) was added at 100 µL per well and incubated at RT for 2 hrs. The plate was then washed three times and incubated with 0.25 µg/mL of HRP-SA (Jackson ImmuneResearch) at 100 µL per well for 30 min, followed by 3 washes and incubation with 100 µL of ABTS for 2 mins at RT. Absorbance was read at 405 nm. As shown in FIG. 113, 7t15-21s137L (short version) showed significant interaction with 4.1BB/Fc as compared to 7t15-21s.

Detection of IL-15, IL-21, and IL-7 in 7t15-21s137L (Short Version) with ELISA

Figure 114A:
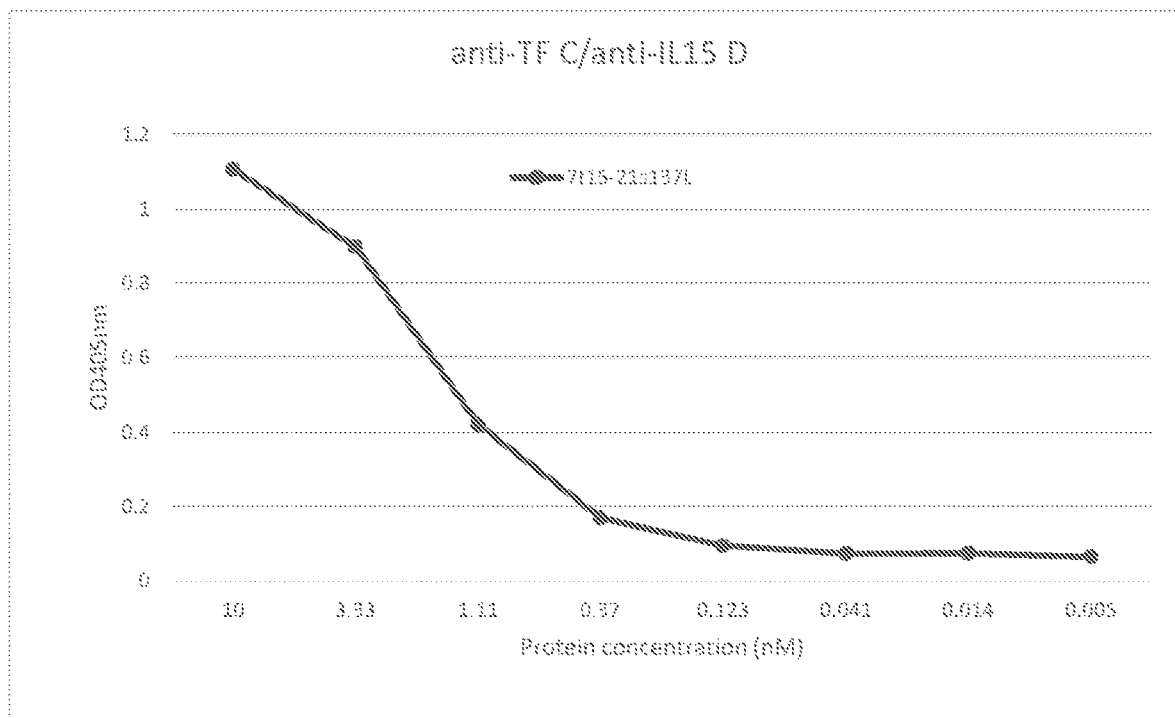
FIGS. 114A-114C show detection of IL-15, IL21, and IL7 in 7t15-21s137L (short version) with ELISA.
Figure 114B:
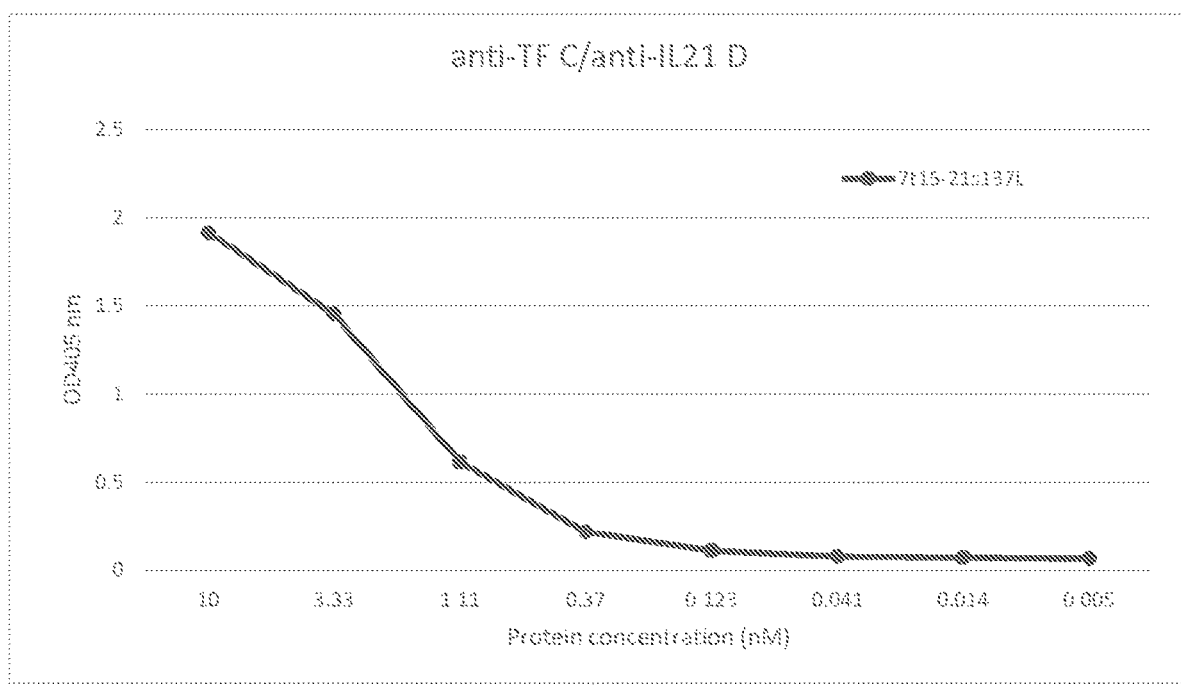
Figure 114C:
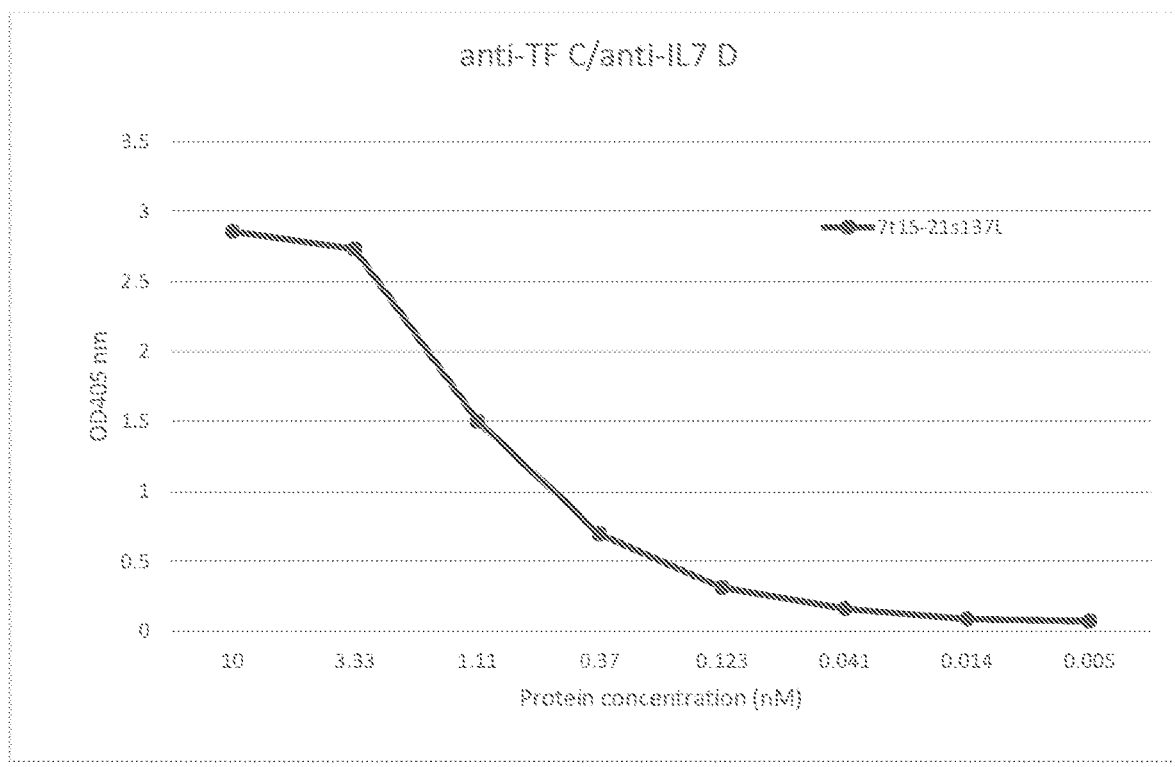

A 96-well plate was coated with 100 µL (8 µg/mL) of anti-TF antibody IgG1 in R5 (coating buffer) and incubated at RT for 2 hrs. The plates were washed 3 times and blocked with 100 µL of 1% BSA in PBS. 7t15-21s137L (short version), serially diluted at a 1:3 ratio was added, and incubated at RT for 60 min. After three washes, 50 ng/mL of biotinylated-anti-IL-15 antibody (BAM247, R&D Systems), 500 ng/mL of biotinylated-anti-IL21 antibody (13-7218-81, R&D Systems), or 500 ng/mL of biotinylated-anti-IL7 antibody (506602, R&D Systems) was added to the wells and incubated at RT for 60 min. After three washes and incubation with 0.25 µg/mL of HRP-SA (Jackson ImmunoResearch) at 100 µL per well was carried out for 30 min at RT, followed by four washes and incubation with 100 µL of ABTS for 2 mins at RT. Absorbance was read at 405 nm. As shown in FIGS. 114A-114C, the IL-15, IL-21, and IL-7 domains in 7t15-21s137L (short version) were detected by the respective antibodies.

Figure 115:
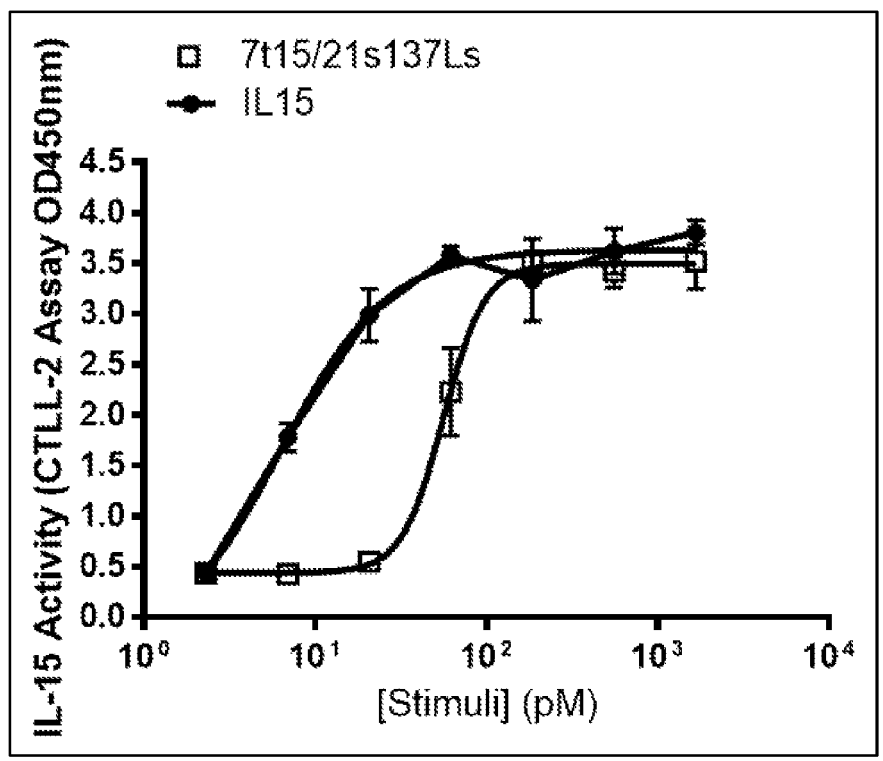
FIG. 115 shows results from a CTLL-2 cell proliferation assay.

The IL-15 in 7t15-1s137L (Short Version) Promotes IL2Rαβγ Containing CTLL2 Cell Proliferation To evaluate the IL-15 activity of 7t15-21s137L (short version), 7t15-21s137L (short version) was compared with recombinant IL-15 in promoting proliferation of IL2Rαβγ expressing CTLL2 cells. IL-15-dependent CTLL2 cells were washed 5 times with IMDM-10% FBS and seeded to the wells at $2\times10^4$ cells/well. Serially diluted 7t15-21s137L (short version) or IL-15 were added to the cells (FIG. 115). Cells were incubated in a $CO_2$ incubator at 37° C. for 3 days. Cell proliferation was detected by adding 10 µL of WST1 to each well on day 3 and incubated for an additional 3 hours in a $CO_2$ incubator at 37° C. The amount of formazan dye produced was analyzed by measuring the absorbance at 450 nm. As shown in FIG. 115, 7t15-21s137L (short version) and IL-15 promoted CTLL2 cell proliferation. The $EC_{50}$ of 7t15-21s137L (short version) and IL-15 was 55.91 pM and 6.22 pM. respectively.

Figure 116:
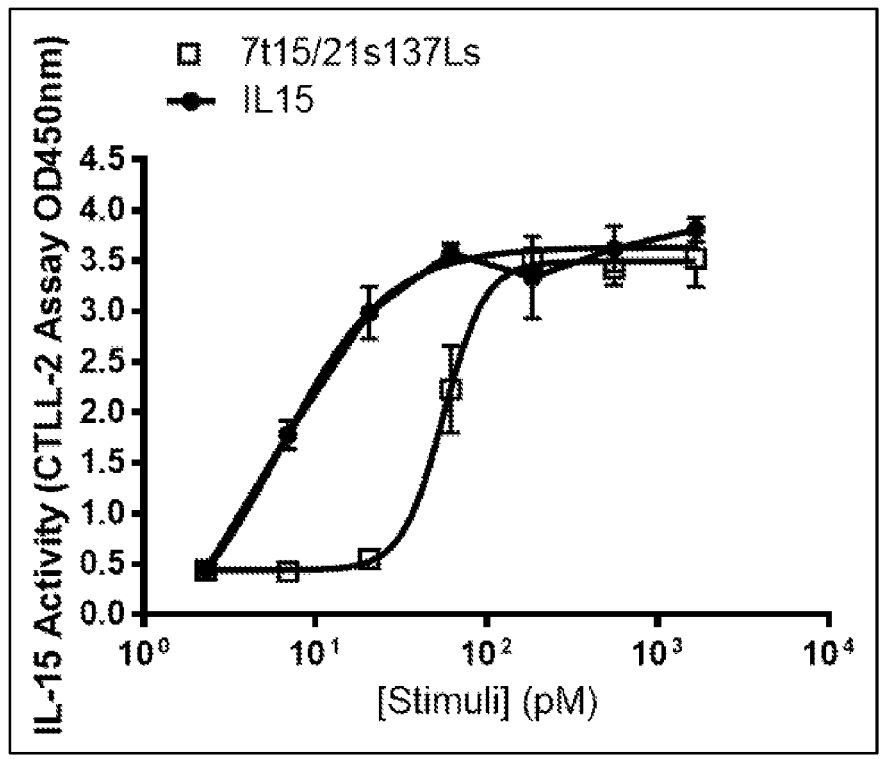
FIG. 116 shows the activity of 7t15-1s137L (short version) in promoting IL21R containing B9 cell proliferation.

The IL-21 in 7t15-1s137L (Short Version) Promotes IL21R Containing B9 Cell Proliferation To evaluate the IL-21 activity of 7t15-21s137L (short version), 7t15-21s137L (short version) was compared with recombinant IL-21 in promoting proliferation of IL-21R expressing B9 cells. IL-21R containing B9 cells were washed 5 times with RPMI-10% FBS and seeded to the wells at $1\times10^4$ cells/well. Serially diluted 7t15-21s137L (short version) or IL-21 were added to the cells (FIG. 116). Cells were incubated in a $CO_2$ incubator at 37° C. for 5 days. Cell proliferation was detected by adding 10 µL of WST1 to each well on day 5 and incubated for an additional 4 hours in a $CO_2$ incubator at 37° C. The amount of formazan dye produced was analyzed by measuring the absorbance at 450 nm. As shown in FIG. 116, 7t15-21s137L (short version) and IL-21 promoted B9 cell proliferation. The $EC_{50}$ of 7t15-21s137L (short version) and IL-21 was 104.1 nM and 72.55 nM. respectively.

Example 56: 7t15-TGFRs Fusion Protein Generation and Characterization

Figure 117:
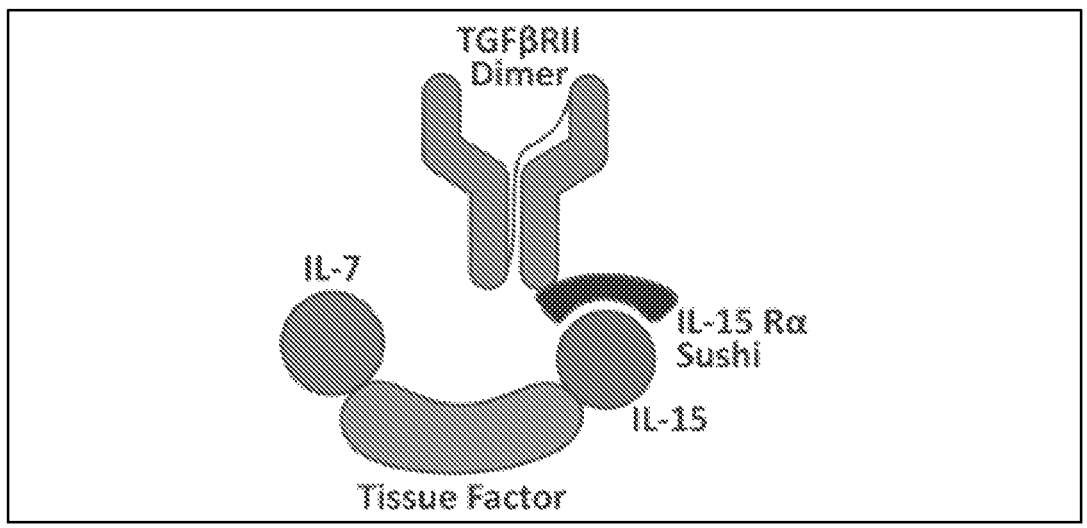
FIG. 117 shows a schematic of the 7t15-TGFRs construct.
Figure 118:
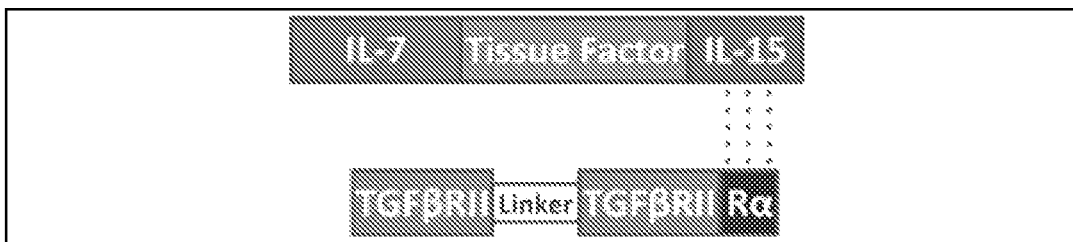
FIG. 118 shows an additional schematic of the 7t15-TGFRs construct.

A fusion protein complex was generated comprising of TGFβ Receptor II/IL-15RαSu and IL-7/TF/IL-15 fusion proteins (FIG. 117 and FIG. 118). The human TGFβ Receptor II (Ile24-Asp159), tissue factor 219, IL-15, and IL-7 sequences were obtained from the UniProt website and DNA for these sequences was synthesized by Genewiz. Specifically, a construct was made linking the IL-7 sequence to the N-terminus coding region of tissue factor 219 followed by the N-terminus coding region of IL-15. The nucleic acid and protein sequences of a construct comprising IL-7 linked to the N-terminus of tissue factor 219 following with the N-terminus of IL-15 are shown below.

The nucleic acid sequence of the 7t15 construct (including signal peptide sequence) is as follows:

(Signal peptide)
ATGAAGTGGGTGACCTTCATCAGCCTGCTGTTCCTGTTCTCCAGCGCCTA

CTCC (Human IL7)
GATTGCGACATCGAGGGCAAGGACGGCAAGCAGTACGAGAGCGTGCT

GATGGTGTCCATCGACCAGCTGCTGGACAGCATGAAGGAGATCGGCTCCA

ACTGCCTCAACAACGAGTTCAACTTCTTCAAGCGGCACATCTGCGACGCC

AACAAGGAGGGCATGTTCCTGTTCAGGGCCGCCAGGAAACTGCGGCAGTT

CCTGAAGATGAACTCCACCGGCGACTTCGACCTGCACCTGCTGAAGGTGT

CCGAGGGCACCACCATCCTGCTGAACTGCACCGGACAGGTGAAGGGCCGG

AAACCTGCTGCTCTGGGAGAGGCCCAACCCACCAAGAGCCTGGAGGAGAA

CAAGTCCCTGAAGGAGCAGAAGAAGCTGAACGACCTGTGCTTCCTGAAGA

GGCTGCTGCAGGAGATCAAGACCTGCTGGAACAAGATCCTGATGGGCACC

AAGGAGCAT (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC

The amino acid sequence of 7t15 fusion protein (including the leader sequence) is as follows:

(Signal peptide)
MKWVTFISLLFLFSSAYS (Human IL7)
DCDIEGKDGKQYESVLMVSIDQLLDSMKEIGSNCLNNEFNFFKRHICDAN

KEGMFLFRAARKLRQFLKMNSTGDFDLHLLKVSEGTTILLNCTGQVKGRK

PAALGEAQPTKSLEENKSLKEQKKLNDLCFLKRLLQEIKTCWNKILMGTK

EH (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

Constructs were also made by attaching two TGFβ Receptor II directly to the IL-15RαSu chain which was synthesized by Genewiz. The nucleic acid and protein sequences of a construct comprising the TGFβ Receptor II linked to the N-terminus of IL-15RαSu are shown below.

The nucleic acid sequence of the TGFRs construct (including signal peptide sequence) is as follows:

(Signal peptide)
ATGAAGTGGGTGACCTTCATCAGCCTGCTGTTCCTGTTCTCCAGCGCCT

ACTCC (Human TGFβ Receptor II fragments)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCAGCA

TCACCTCCATCTGCGAGAAGCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG

CAACCCTGATGGAGGTGGCGGATCCGGAGGTGGAGGTTCTGGTGGAGGTG

GGAGTATTCCTCCCCACGTGCAGAAGAGCGTGAATAATGACATGATCGTG

ACCGATAACAATGGCGCCGTGAAATTTCCCCAGCTGTGCAAATTCTGCGA

TGTGAGGTTTTCCACCTGCGACAACCAGAAGTCCTGTATGAGCAACTGCT

CCATCACCTCCATCTGTGAGAAGCCTCAGGAGGTGTGCGTGGCTGTCTGG

CGGAAGAATGACGAGAATATCACCCTGGAAACCGTCTGCCACGATCCCAA

GCTGCCCTACCACGATTTCATCCTGGAAGACGCCGCCAGCCCTAAGTGCA

-continued
TCATGAAAGAGAAAAAGAAGCCTGGCGAGACCTTTTTCATGTGCTCCTGC

AGCAGCGACGAATGCAACGACAATATCATCTTTAGCGAGGAATACAATAC

CAGCAACCCCGAC (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG

The amino acid sequence of TGFRs fusion protein (including the leader sequence) is as follows:

(Signal peptide)
MKWVTFISLLFLFSSAYS (Human TGFβ Receptor II)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD (Human IL-15R α sushi domain)
ITCPPPMSVEHADIWVKSYSLYSRERYICNSGFKRKAGTSSLTECVLNKA

TNVAHWTTPSLKCIR

Effect of 7t15-TGFRs on TGFβ1 Activity in HEK-Blue TGFβ Cells

Figure 119:
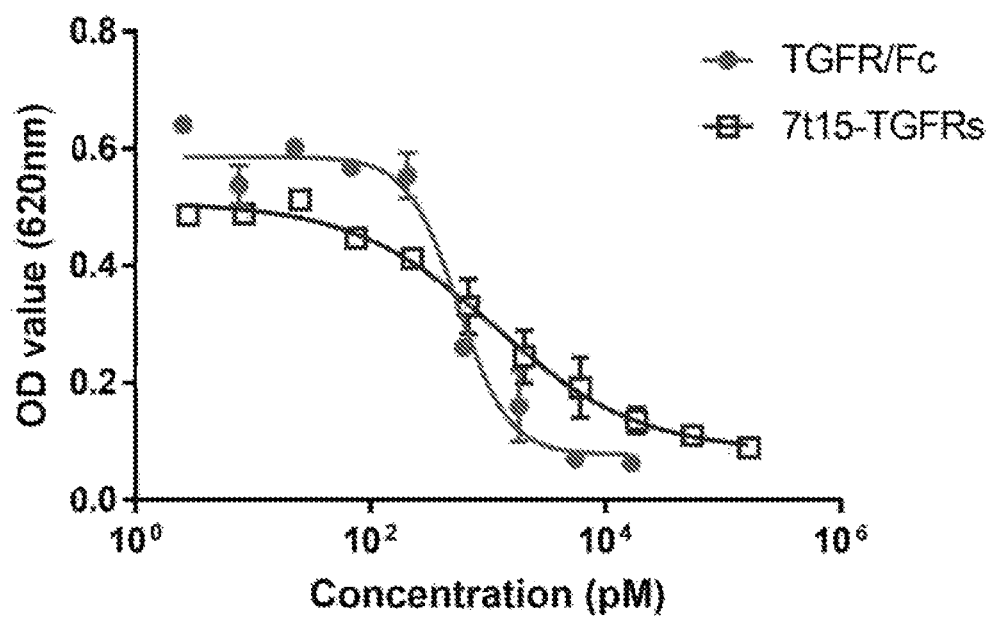
FIG. 119 shows results of TGFβ1 inhibition by 7t15-TGFRs and TGFR-Fc.

To evaluate the activity of TGFβR in 7t15-TGFRs, the effect of 7t15-TGFRs on the activity of TGFβ1 in HEK-Blue TGFβ cells was analyzed. HEK-Blue TGFβ cells (Invivogen) were washed twice with pre-warmed PBS and resuspended in the testing medium (DMEM, 10% heat-inactivated FCS, 1× glutamine, 1× anti-anti, and 2× glutamine) at $5\times10^5$ cells/mL. In a flat-bottom 96-well plate, 50 µL cells were added to each well ($2.5\times10^4$ cells/well) and followed with 50 µL 0.1 nM TGFβ1 (R&D systems). 7t15-TGFRs or TGFR-Fc (R&D Systems) prepared at a 1:3 serial dilution was then added to the plate to reach a total volume of 200 µL. After 24 hrs of incubation at 37° C., 40 µL of induced HEK-Blue TGFβ cell supernatant was added to 160 µL pre-warmed QUANTI-Blue (Invivogen) in a flat-bottom 96-well plate, and incubated at 37° C. for 1-3 hrs. The OD values were then determined using a plate reader (Multiscan Sky) at 620-655 nM. The data are shown in FIG. 119. The $IC_{50}$ of each protein sample was calculated with GraphPad Prism 7.04. The $IC_{50}$ of 7t15-TGFRs and TGFR-Fc were 1142 pM and 558.6 pM respectively. These results showed that the TGFβR in 7t15-TGFRs was able to block the activity of TGFβ1 in HEK-Blue TGF cells.

Detection of IL-15, TGFβRII, and IL-7 in 7t15-TGFRs with ELISA

Figure 120A:
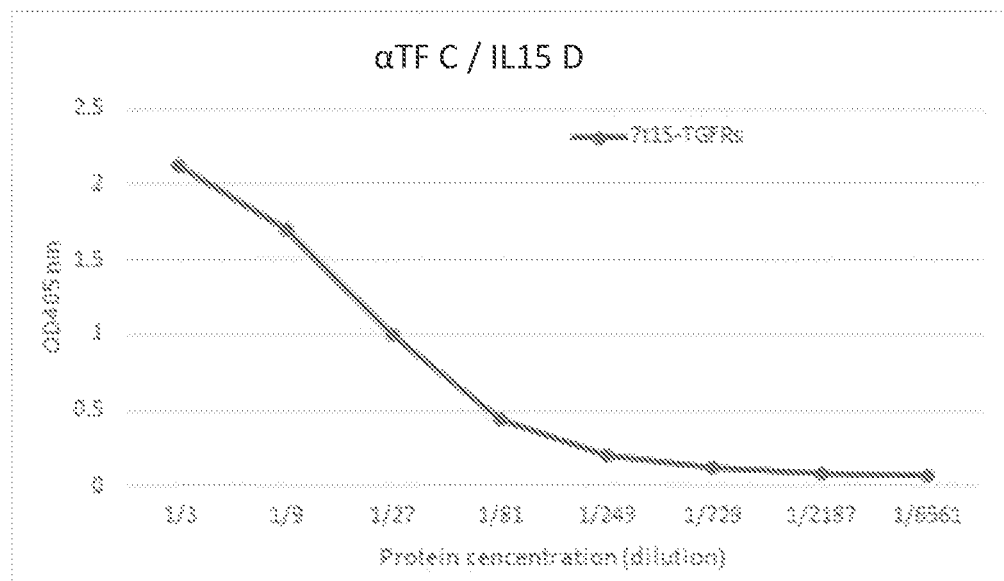
FIGS. 120A-120C show detection of IL-15, TGFβRII, and IL-7 in 7t15-TGFRs with ELISA.
Figure 120B:
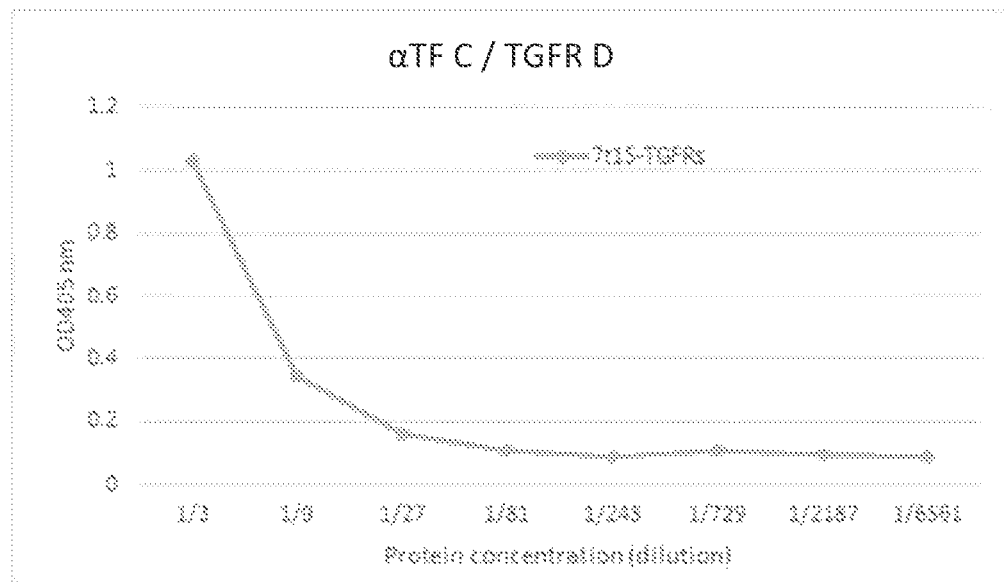
Figure 120C:
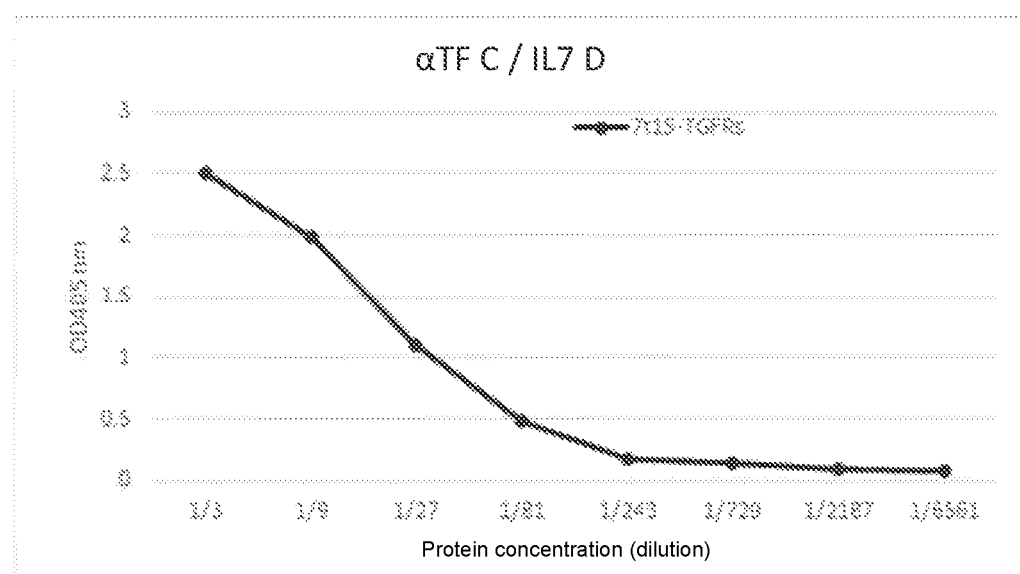

A 96-well plate was coated with 100 µL (8 µg/mL) of anti-TF antibody IgG1 in R5 (coating buffer) and incubated at room temperature (RT) for 2 hrs. The plates were washed three times and blocked with 100 µL of 1% BSA in PBS. Serial dilution of 7t15-TGFRs (1:3 ratio) was added, and incubated at RT for 60 mins. After 3 washes, 50 ng/mL of biotinylated-anti-IL-15 antibody (BAM247, R&D Systems), 200 ng/mL of biotinylated-anti-TGFbRII antibody (BAF241, R&D Systems), or 500 ng/mL of biotinylated-anti-IL-7 antibody (506602, R&D Systems) was added and incubated at RT for 60 min. Following three washes, incubation with 0.25 µg/mL of HRP-SA (Jackson ImmunoResearch) at 100 µL per well was carried out for 30 min at RT, followed by 4 washes and incubation with 100 µL of ABTS for 2 mins at RT. Absorbance was read at 405 nm. As shown in FIGS. 120A-120C, the IL-15, TGFR, and IL-7 in 7t15-TGFRs were detected by the respective antibodies.

Figure 121:
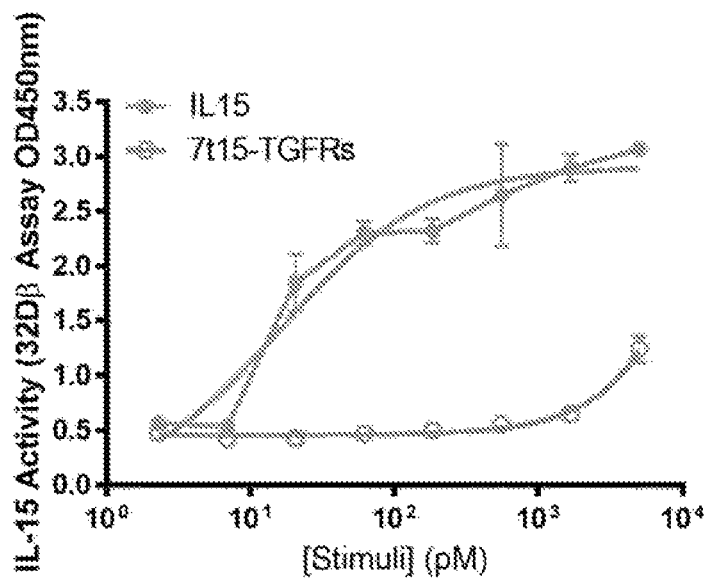

The IL-15 in 7t15-TGFRs Promotes IL-2Rβ and Common γ Chain Containing 32Dβ Cell Proliferation To evaluate the activity of IL-15 in 7t15-TGFRs, 7t15-TGFRs was compared to recombinant IL-15 using 32D3 cells that express IL2R13 and common γ chain, and evaluating their effects on promoting cell proliferation. IL-15 dependent 32Dβ cells were washed 5 times with IMDM-10% FBS and seeded in the wells at $2\times10^4$ cells/well. Serially-diluted 7t15-TGFRs or IL-15 were added to the cells (FIG. 121). Cells were incubated in a $CO_2$ incubator at 37° C. for 3 days. Cell proliferation was detected by adding 10 µL of WST1 to each well on day 3 and incubating for an additional 3 hours in a $CO_2$ incubator at 37° C. The amount of formazan dye produced was analyzed by measuring the absorbance at 450 nm. As shown in FIG. 121, 7t15-TGFRs and IL-15 promoted 32DP cell proliferation, with the $EC_{50}$ of 7t15-TGFRs and IL-15 being 126 nM and 16.63 pM, respectively.

Figure 122:
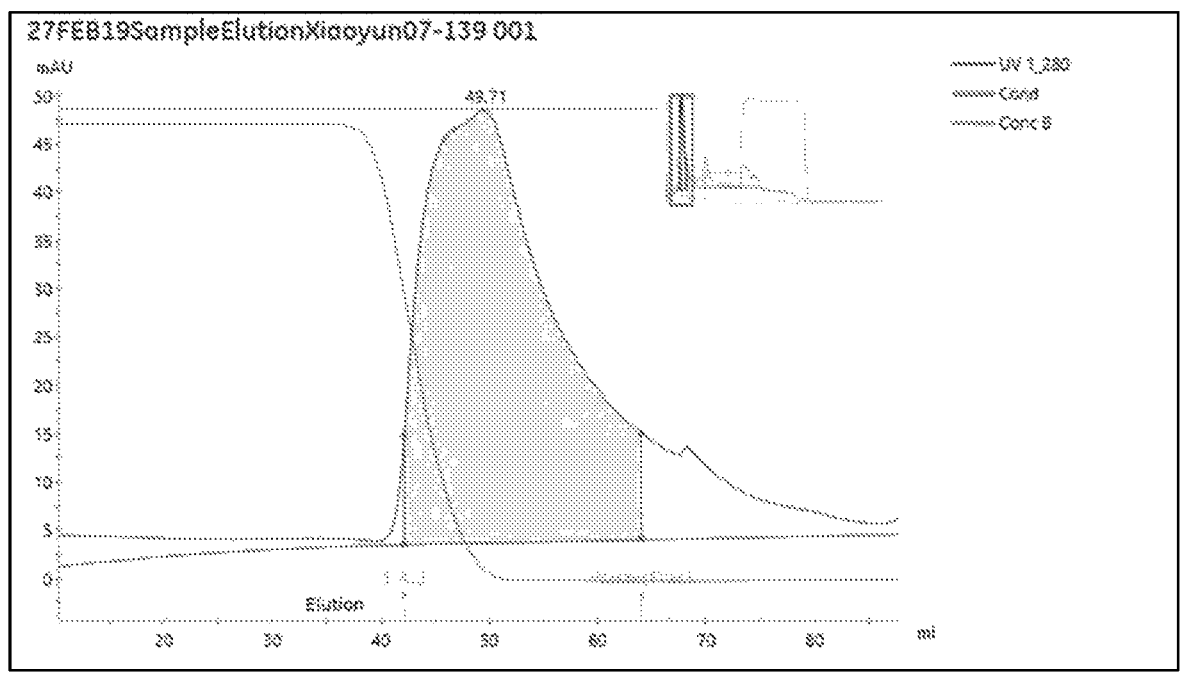

Purification Elution Chromatograph of 7t15-TGFRs Using Anti-TF Antibody Affinity Column 7t15-TGFRs harvested from cell culture was loaded onto the anti-TF antibody affinity column equilibrated with 5 column volumes of PBS. After sample loading, the column was washed with 5 column volumes of PBS, followed by elution with 6 column volumes of 0.1M acetic acid (pH 2.9). A280 elution peak was collected and then neutralized to pH 7.5-8.0 with 1M Tris base. The neutralized sample was then buffer exchanged into PBS using Amicon centrifugal filters with a 30 KDa molecular weight cutoff. As shown in FIG. 122, the anti-TF antibody affinity column can bind 7t15-TGFRs which contains TF as a fusion partner of 7t15-TGFRs. The buffer-exchanged protein sample was stored at 2-8° C. for further biochemical analyses and biological activity tests. After each elution, the anti-TF antibody affinity column was stripped using 6 column volumes of 0.1M glycine (pH 2.5). The column was then neutralized using 5 column volumes of PBS, and 7 column volumes of 20% ethanol for storage. The anti-TF antibody affinity column was connected to a GE Healthcare AKTA Avant system. The flow rate was 4 mL/min for all steps except for the elution step, which was 2 mL/min.

Reduced SDS-PAGE Analysis of 7t15-TGFRs

To determine the purity and molecular weight of the protein, 7t15-TGFRs protein sample purified with anti-TF antibody affinity column was analyzed by sodium dodecyl sulfate polyacrylamide gel (4-12% NuPage Bis-Tris gel) electrophoresis (SDS-PAGE) method under reduced condition. After electrophoresis, the gel was stained with InstantBlue for about 30 min, followed by destaining overnight in purified water.

Figure 123:
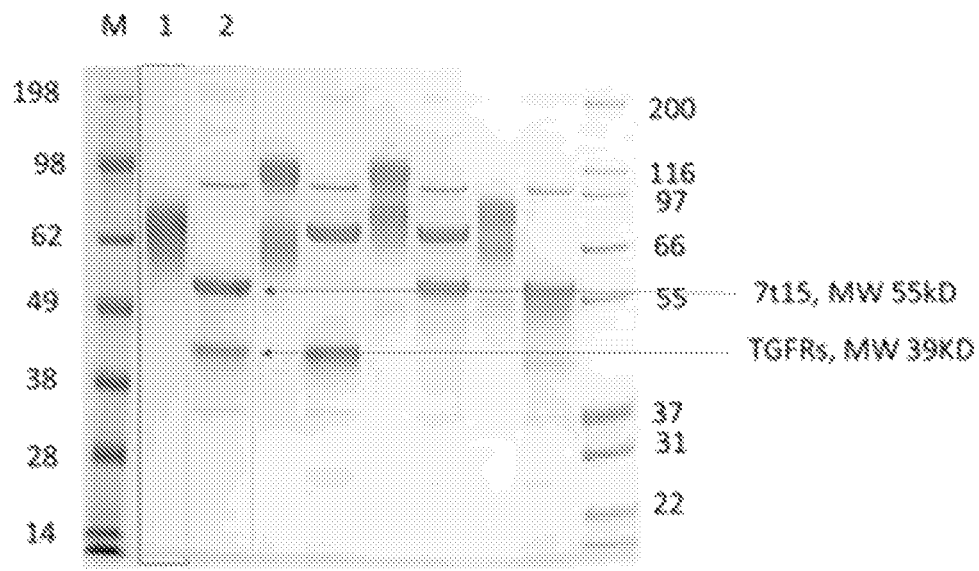

To verify that the 7t15-TGFRs protein undergoes glycosylation after translation in CHO cells, a deglycosylation experiment was conducted using the Protein Deglycosylation Mix II kit from New England Biolabs and the manufacturer's instructions. FIG. 123 shows reduced SDS-PAGE analysis of the sample in non-deglycosylated (lane 1) and deglycosylated (lane 2) state. These results showed that the protein is glycosylated when it is expressed in CHO cells. After deglycosylation, the purified sample showed expected molecular weights (55 kDa and 39 kDa) in reduced SDS gel. Lane M was loaded with 10 ul of SeeBlue Plus2 Prestained Standard.

Characterization of 7t15-TGFRs

7t15-TGFRs is a multi-chain polypeptide (a type A multi-chain polypeptide described herein) that includes the first polypeptide that is a soluble fusion of human IL-7, human tissue factor 219 fragment and human IL-15 (7t15), and the second polypeptide that is a soluble fusion of single chain two TGFβRII domains and sushi domain of human IL-15 receptor alpha chain (TGFRs).

Figure 124:
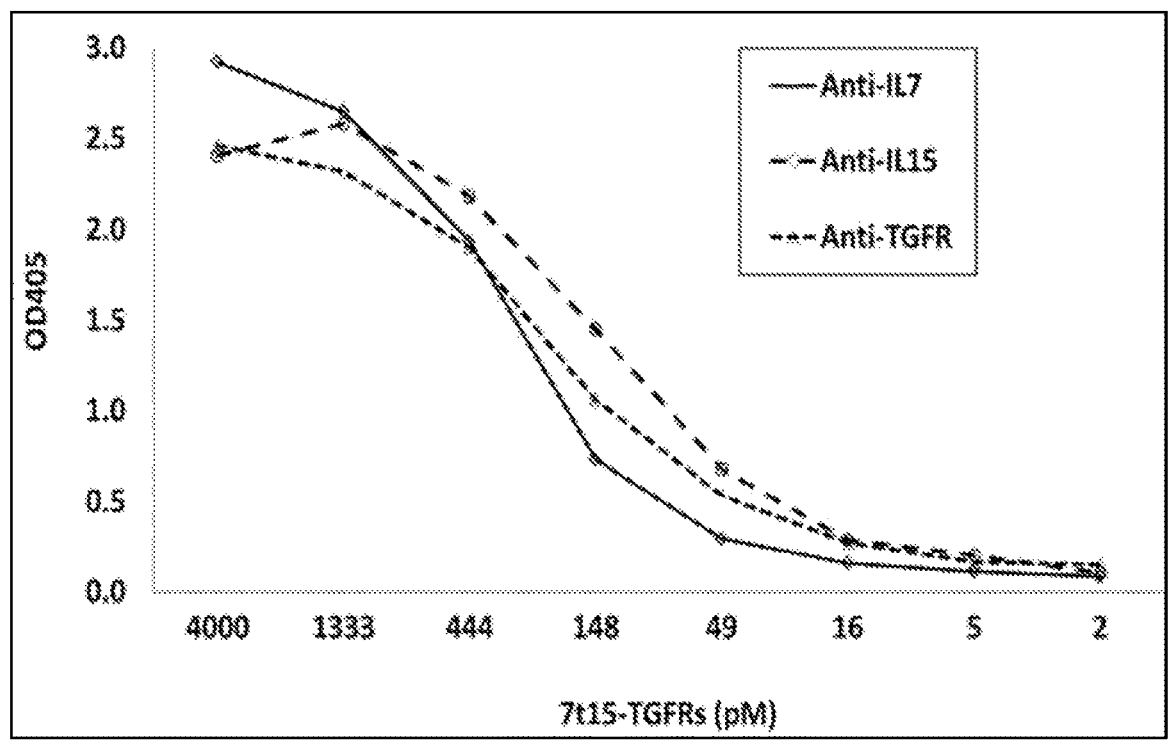

CHO cells were co-transfected with 7t15 and TGFRs vectors. The 7t15-TGFRs complex was purified from the transfected CHO cell culture supernatant. The IL-7, IL-15, TGFβ receptor and tissue factor (TF) components were demonstrated in the complex by ELISA as shown in FIG. 124. A humanized anti-TF antibody monoclonal antibody (anti-TF antibody IgG1) was used as the capture antibody to determine TF in 7t15-TGFRs, and biotinylated antibodies against human IL-15 (R&D systems), human IL-7 (Biolegend), anti-TGFβ receptor (R&D Systems) were used as the detection antibodies to respectively determine IL-7, IL-15 and TGFβ receptor in 7t15-TGFRs. Peroxidase conjugated streptavidin (Jackson ImmunoResearch Lab) and ABTS substrate (Surmodics IVD, Inc.) were then used to detect the bound biotinylated antibodies. The results were analyzed by ELISA (FIG. 124).

In Vivo Characterization of 7t15-TGFRs in C57BL/6 Mice

To determine the immunostimulatory activity of 7t15-TGFRs in vivo, C57BL/6 mice were subcutaneously treated with control solution (PBS) or 7t15-TGFRs at 0.3, 1, 3 and 10 mg/kg. The treated mice were euthanized. The mouse spleens were collected and weighed day 4 post treatment. Single splenocyte suspensions were prepared and stained with fluorochrome-conjugated anti-CD4, anti-CD8, and anti-NK1.1 antibodies and the percentage of CD4$^+$ T cells, CD8$^+$ T cells, and NK cells was analyzed by flow cytometry. The results showed that 7t15-TGFRs was effective at expanding splenocytes based on spleen weight (FIG. 125A), especially at 1-10 mg/kg. The percentages of CD8$^+$ T cells and NK cells were higher compared to control-treated mice (FIG. 125B) at all doses tested.

CD44 Expression of CD4$^+$ and CD8$^+$ T Cells

It has been known that IL-15 induces CD44 expression on T cells and development of memory T cells. CD44 expression of CD4$^+$ and CD8$^+$ T cells in the 7t15-TGFRs treated mice were assessed. C57BL/6 mice were subcutaneously treated with 7t15-TGFRs. The splenocytes were stained with fluorochrome-conjugated anti-CD4, anti-CD8 and anti-CD44 monoclonal antibodies for immunocyte subsets. The percentages of CD4$^+$CD44$^{high}$ T cells of total CD4+ T cells and CD8$^+$CD44$^{high}$ T cells of total CD8$^+$ T cells were analyzed by flow cytometry. As shown in FIGS. 126A and 126B, 7t15-TGFRs significantly activated CD4$^+$ and CD8$^+$ T cells to differentiate into memory T cells.

Furthermore, the dynamic proliferation of immune cells based on Ki67 expression of splenocytes and cytotoxicity potential based on granzyme B expression of the splenocytes induced by 7t15-TGFRs after the single dose treatment of mouse were also evaluated. C57BL/6 mice were subcutaneously treated with 7t15-TGFRs at 3 mg/kg. The treated mice were euthanized and the splenocytes were prepared. The prepared splenocytes were stained with fluorochrome-conjugated anti-CD4, anti-CD8, and anti-NK1.1 (NK) antibodies for immunocyte subsets and then intracellularly stained with anti-Ki67 antibody for cell proliferation and anti-granzyme B antibody for cytotoxic marker. The mean fluorescent intensity (MFI) of Ki67 and granzyme B of corresponding immunocyte subsets was analyzed by flow cytometry. As shown in FIGS. 127A and 127B, in the spleens of mice treated with 7t15-TGFRs, the expression of Ki67 and granzyme B by CD8$^+$ T cells and NK cells increased compared with PBS control treatment. These results demonstrate that 7t15-TGFRs is not only to increase numbers of CD8$^+$ T cells and NK cells but also enhance potential cytotoxicity of these cells.

Additionally, cytotoxicity of the mouse splenocytes against tumor cells was also evaluated. Mouse Yac-1 cells were labeled with CellTrace Violet and used as tumor target cells. The splenocytes were prepared from 7t15-TGFRs-treated mice and used as effector cells. The target cells were mixed with effector cells at E:T ratio=10:1 in RPMI-10 medium with or without 7t15-TGFRs at 100 nM and incubated at 37° C. for 20 hours. Target Yac-1 cell inhibition was assessed by analysis of viable CellTrace Violet-labeled Yac-1 cells using flow cytometry. Percentage of Yac-1 inhibition was calculated using a formula, (1-viable Yac-1 cell number in experimental sample/viable Yac-1 cell number in the sample without splenocytes)×100. As shown in FIG. 128, 7t15-TGFRs-treated mouse splenocytes had stronger cytotoxicity against Yac-1 cells than the control mouse splenocytes and addition of 7t15-TGFRs during cytotoxic assay further enhanced cytotoxicity of splenocytes against Yac-1 target cells.

Example 57: TGFRt15-21s137L Fusion Protein Generation and Characterization

A fusion protein complex was generated comprising IL-21/IL-15RαSu/CD137L and TGFβ Receptor II/TF/IL-15 fusion proteins (FIG. 129 and FIG. 130). The human TGFβ Receptor II (Ile24-Asp159), tissue factor 219, and IL-15 sequences were obtained from the UniProt website and DNA for these sequences was synthesized by Genewiz. Specifically, a construct was made linking two TGFβ Receptor II sequences with a G4S(3) linker to generate a single chain version of TGFβ Receptor II and then directly linking to the N-terminus coding region of tissue factor 219 followed by the N-terminus coding region of IL-15.

The nucleic acid sequence of the TGFRt15 construct (including signal peptide sequence) is as follows:

```
(Signal peptide)
ATGAAGTGGGTGACCTTCATCAGCCTGCTGTTCCTGTTCTCCAGCGCCT

ACTCC (Human TGFβ Receptor II fragments)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCAGCA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG
```

-continued
CAACCCTGATGGAGGTGGCGGATCCGGAGGTGGAGGTTCTGGTGGAGGTG

GGAGTATTCCTCCCCACGTGCAGAAGAGCGTGAATAATGACATGATCGTG

ACCGATAACAATGGCGCCGTGAAATTTCCCCAGCTGTGCAAATTCTGCGA

TGTGAGGTTTTCCACCTGCGACAACCAGAAGTCCTGTATGAGCAACTGCT

CCATCACCTCCATCTGTGAGAAGCCTCAGGAGGTGTGCGTGGCTGTCTGG

CGGAAGAATGACGAGAATATCACCCTGGAAACCGTCTGCCACGATCCCAA

GCTGCCCTACCACGATTTCATCCTGGAAGACGCCGCCAGCCCTAAGTGCA

TCATGAAAGAGAAAAAGAAGCCTGGCGAGACCTTTTTCATGTGCTCCTGC

AGCAGCGACGAATGCAACGACAATATCATCTTTAGCGAGGAATACAATAC

CAGCAACCCCGAC (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC

The amino acid sequence of TGFRt15 fusion protein (including the leader sequence) is as follows:

(Signal peptide)
MKWVTFISLLFLFSSAYS (Human TGFβ Receptor II)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

-continued
ITSICEKPQEVCVAVWRKNDENITLETVCHDPKLPYHDFILEDAASPKCI

MKEKKKPGETFFMCSCSSDECNDNIIFSEEYNTSNPD (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

The nucleic acid and protein sequences of the 21s137L are shown below. The nucleic acid sequence of the 21s137L construct (including signal peptide sequence) is as follows:

(Signal peptide)
ATGAAGTGGGTGACCTTCATCAGCCTGCTGTTCCTGTTCTCCAGCGCCT

ACTCC (Human IL-21)
CAGGGCCAGGACAGGCACATGATCCGGATGAGGCAGCTCATCGACAT

CGTCGACCAGCTGAAGAACTACGTGAACGACCTGGTGCCCGAGTTTCTGC

CTGCCCCCGAGGACGTGGAGACCAACTGCGAGTGGTCCGCCTTCTCCTGC

TTTCAGAAGGCCCAGCTGAAGTCCGCCAACACCGGCAACAACGAGCGGAT

CATCAACGTGAGCATCAAGAAGCTGAAGCGGAAGCCTCCCTCCACAAACG

CCGGCAGGAGGCAGAAGCACAGGCTGACCTGCCCCAGCTGTGACTCCTAC

GAGAAGAAGCCCCCCAAGGAGTTCCTGGAGAGGTTCAAGTCCCTGCTGCA

GAAGATGATCCATCAGCACCTGTCCTCCAGGACCCACGGCTCCGAGGACT

CC (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG ((G4S)3 linker)
GGCGGTGGAGGATCCGGAGGAGGTGGCTCCGGCGGCGGAGGATCT (Human CD137L)
CGCGAGGGTCCCGAGCTTTCGCCCGACGATCCCGCCGGCCTCTTGGAC

CTGCGGCAGGGCATGTTTGCGCAGCTGGTGGCCCAAAATGTTCTGCTGAT

CGATGGGCCCCTGAGCTGGTACAGTGACCCAGGCCTGGCAGGCGTGTCCC

TGACGGGGGGCCTGAGCTACAAAGAGGACACGAAGGAGCTGGTGGTGGCC

AAGGCTGGAGTCTACTATGTCTTCTTTCAACTAGAGCTGCGGCGCGTGGT

GGCCGGCGAGGGCTCAGGCTCCGTTTCACTTGCGCTGCACCTGCAGCCAC

TGCGCTCTGCTGCTGGGGCCGCCGCCCTGGCTTTGACCGTGGACCTGCCA

CCCGCCTCCTCCGAGGCTCGGAACTCGGCCTTCGGTTTCCAGGGCCGCTT

-continued
GCTGCACCTGAGTGCCGGCCAGCGCCTGGGCGTCCATCTTCACACTGAGG

CCAGGGCACGCCATGCCTGGCAGCTTACCCAGGGCGCCACAGTCTTGGGA

CTCTTCCGGGTGACCCCCGAAATCCCAGCCGGACTCCCTTCACCGAGGTC

GGAA

The amino acid sequence of 21s137L fusion protein (including the leader sequence) is as follows:

(Signal peptide)
MKWVTFISLLFLFSSAYS (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS (Human IL-15R α sushi domain)
ITCPPPMSVEHADIWVKSYSLYSRERYICNSGFKRKAGTSSLTECVLNKA

TNVAHWTTPSLKCIR ((G4S)3 linker)
GGGGSGGGGSGGGGS (Human CD137L)
REGPELSPDDPAGLLDLRQGMFAQLVAQNVLLIDGPLSWYSDPGLAGVS

LTGGLSYKEDTKELVVAKAGVYYVFFQLELRRVVAGEGSGSVSLALHLQP

LRSAAGAAALALTVDLPPASSEARNSAFGFQGRLLHLSAGQRLGVHLHTE

ARARHAWQLTQGATVLGLFRVTPEIPAGLPSPRSE

In some cases, the leader peptide is cleaved from the intact polypeptide to generate the mature form that may be soluble or secreted.

The IL-21/IL-15RαSu/CD137L and TGFR/TF/IL-15 constructs were cloned into a modified retrovirus expression vectors as described previously (Hughes M S, Yu Y Y, Dudley M E, Zheng Z, Robbins P F, Li Y, et al. Transfer of a TCR gene derived from a patient with a marked antitumor response conveys highly active T-cell effector functions. *Hum Gene Ther* 2005; 16:457-72), and the expression vectors were transfected into CHO-K1 cells. Co-expression of the two constructs in CHO-K1 cells allowed for formation and secretion of the soluble TGFR/TF/IL-15: IL-21/IL-15RαSu/CD137L protein complex (referred to as TGFRt15-21s137L), which can be purified by anti-TF antibody IgG1 affinity and other chromatography methods.
Purification Elution Chromatograph of TGFRt15-21s137L Using Anti-TF Antibody Affinity Column TGFRt15-21s137L harvest from cell culture was loaded onto the anti-TF antibody affinity column equilibrated with 5 column volumes of PBS. After sample loading, the column was washed with 5 column volumes of PBS, followed by elution with 6 column volumes of 0.1M acetic acid (pH 2.9). A280 elution peak was collected and then neutralized to pH 7.5-8.0 with 1M Tris base. The neutralized sample was then buffer exchanged into PBS using Amicon centrifugal filters with a 30 KDa molecular weight cutoff. As shown in FIG. 131, the anti-TF antibody affinity column bound to TGFRt15-21s137L which contains TF as a fusion partner of TGFRt15-21s137L. The buffer-exchanged protein sample was stored at 2-8° C. for further biochemical analyses and biological activity tests. After each elution, the anti-TF antibody affinity column was stripped using 6 column volumes of 0.1M glycine (pH 2.5). The column was then neutralized using 5 column volumes of PBS, and 7 column volumes of 20% ethanol for storage. The anti-TF antibody affinity column was connected to a GE Healthcare AKTA Avant system. The flow rate was 4 mL/min for all steps except for the elution step, which was 2 mL/min.

Example 58: TGFRt15-TGFRs21 Fusion Protein Generation and Characterization

A fusion protein complex was generated comprising of TGFβ Receptor II/IL-15RαSu/IL-21 and TGFβ Receptor II/TF/IL-15 fusion proteins (FIG. 132 and FIG. 133). The human TGFβ Receptor II (Ile24-Asp159), tissue factor 219, IL-21, and IL-15 sequences were obtained from the UniProt website and DNA for these sequences was synthesized by Genewiz. Specifically, a construct was made linking two TGFβ Receptor II sequences with a G4S(3) linker to generate a single chain version of TGFβ Receptor II and then directly linking to the N-terminus coding region of tissue factor 219 followed by the N-terminus coding region of IL-15.

The nucleic acid and protein sequences of a construct comprising two TGFβ Receptor II linked to the N-terminus of tissue factor 219 following with the N-terminus of IL-15 are shown below.

The nucleic acid sequence of the TGFRt15 construct (including signal peptide sequence) is as follows:

(Signal peptide)
ATGAAGTGGGTGACCTTCATCAGCCTGCTGTTCCTGTTCTCCAGCGCCT

ACTCC (Human TGFβ Receptor II fragments)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCAGCA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTTATGTGTTCCTGTAGC

AGCGACGAGTGTAACGACAACATCATCTTCAGCGAAGAGTACAACACCAG

CAACCCTGATGGAGGTGGCGGATCCGGAGGTGGAGGTTCTGGTGGAGGTG

GGAGTATTCCTCCCCACGTGCAGAAGAGCGTGAATAATGACATGATCGTG

ACCGATAACAATGGCGCCGTGAAATTTCCCCAGCTGTGCAAATTCTGCGA

TGTGAGGTTTTCCACCTGCGACAACCAGAAGTCCTGTATGAGCAACTGCT

CCATCACCTCCATCTGTGAGAAGCCTCAGGAGGTGTGCGTGGCTGTCTGG

CGGAAGAATGACGAGAATATCACCCTGGAAACCGTCTGCCACGATCCCAA

GCTGCCCTACCACGATTTCATCCTGGAAGACGCCGCCAGCCCTAAGTGCA

TCATGAAAGAGAAAAAGAAGCCTGGCGAGACCTTTTTCATGTGCTCCTGC

AGCAGCGACGAATGCAACGACAATATCATCTTTAGCGAGGAATACAATAC

CAGCAACCCCGAC (Human Tissue Factor 219)
AGCGGCACAACCAACACAGTCGCTGCCTATAACCTCACTTGGAAGAGCA

CCAACTTCAAAACCATCCTCGAATGGGAACCCAAACCCGTTAACCAAGTT

-continued

```
TACACCGTGCAGATCAGCACCAAGTCCGGCGACTGGAAGTCCAAATGTTT
CTATACCACCGACACCGAGTGCGATCTCACCGATGAGATCGTGAAAGATG
TGAAACAGACCTACCTCGCCCGGGTGTTTAGCTACCCCGCCGGCAATGTG
GAGAGCACTGGTTCCGCTGGCGAGCCTTTATACGAGAACAGCCCCGAATT
TACCCCTTACCTCGAGACCAATTTAGGACAGCCCACCATCCAAAGCTTTG
AGCAAGTTGGCACAAAGGTGAATGTGACAGTGGAGGACGAGCGGACTTTA
GTGCGGCGGAACAACACCTTTCTCAGCCTCCGGGATGTGTTCGGCAAAGA
TTTAATCTACACACTGTATTACTGGAAGTCCTCTTCCTCCGGCAAGAAGA
CAGCTAAAACCAACACAAACGAGTTTTTAATCGACGTGGATAAAGGCGAA
AACTACTGTTTCAGCGTGCAAGCTGTGATCCCCTCCCGGACCGTGAATAG
GAAAAGCACCGATAGCCCCGTTGAGTGCATGGGCCAAGAAAAGGGCGAGT
TCCGGGAG (Human IL-15)
AACTGGGTGAACGTCATCAGCGATTTAAAGAAGATCGAAGATTTAATT
CAGTCCATGCATATCGACGCCACTTTATACACAGAATCCGACGTGCACCC
CTCTTGTAAGGTGACCGCCATGAAATGTTTTTTACTGGAGCTGCAAGTTA
TCTCTTTAGAGAGCGGAGACGCTAGCATCCACGACACCGTGGAGAATTTA
ATCATTTTAGCCAATAACTCTTTATCCAGCAACGGCAACGTGACAGAGTC
CGGCTGCAAGGAGTGCGAAGAGCTGGAGGAGAAGAACATCAAGGAGTTTC
TGCAATCCTTTGTGCACATTGTCCAGATGTTCATCAATACCTCC
```

The amino acid sequence of TGFRtl5 fusion protein (including the leader sequence) is as follows:

```
(Signal peptide)
MKWVTFISLLFLFSSAYS (Human TGFβ Receptor II)
IPPHVQKSVNNDMIVTDNNGAVKFPQLCKFCDVRFSTCDNQKSCMSNCSI
TSICEKPQEVCVAVWRKNDENITLETVCHDPKLPYHDFILEDAASPKCIM
KEKKKPGETFFMCSCSSDECNDNIIFSEEYNTSNPDGGGGSGGGGSGGGG
SIPPHVQKSVNNDMIVTDNNGAVKFPQLCKFCDVRFSTCDNQKSCMSNCS
ITSICEKPQEVCVAVWRKNDENITLETVCHDPKLPYHDFILEDAASPKCI
MKEKKKPGETFFMCSCSSDECNDNIIFSEEYNTSNPD (Human Tissue Factor 219)
SGTTNTVAAYNLTWKSTNFKTILEWEPKPVNQVYTVQISTKSGDWKSKC
FYTTDTECDLTDEIVKDVKQTYLARVFSYPAGNVESTGSAGEPLYENSPE
FTPYLETNLGQPTIQSFEQVGTKVNVTVEDERTLVRRNNTFLSLRDVFGK
DLIYTLYYWKSSSSGKKTAKTNTNEFLIDVDKGENYCFSVQAVIPSRTVN
RKSTDSPVECMGQEKGEFRE (Human IL-15)
NWVNVISDLKKIEDLIQSMHIDATLYTESDVHPSCKVTAMKCFLLELQVI
SLESGDASIHDTVENLIILANNSLSSNGNVTESGCKECEELEEKNIKEFL
QSFVHIVQMFINTS
```

Constructs were also made by attaching two TGF Receptor II directly to the IL-15RαSu chain, followed by the N-terminus coding region of IL-21, which was synthesized by Genewiz. The nucleic acid and protein sequences of a construct comprising the TGFβ Receptor II linked to the N-terminus of IL-15RαSu following with the N-terminus of IL-21 are shown below.

The nucleic acid sequence of the TGFRs21 construct (including signal peptide sequence) is as follows:

```
(Signal peptide)
ATGAAGTGGGTGACCTTCATCAGCCTGCTGTTCCTGTTCTCCAGCGCCT
ACTCC (Human TGFβ Receptor II fragments)
ATCCCCCCCCATGTGCAAAAGAGCGTGAACAACGATATGATCGTGACC
GACAACAACGGCGCCGTGAAGTTTCCCCAGCTCTGCAAGTTCTGCGATGT
CAGGTTCAGCACCTGCGATAATCAGAAGTCCTGCATGTCCAACTGCAGCA
TCACCTCCATCTGCGAGAAGCCCCAAGAAGTGTGCGTGGCCGTGTGGCGG
AAAAATGACGAGAACATCACCCTGGAGACCGTGTGTCACGACCCCAAGCT
CCCTTATCACGACTTCATTCTGGAGGACGCTGCCTCCCCAAATGCATCA
TGAAGGAGAAGAAGAAGCCCGGAGAGACCTTCTTTATGTGTTCCTGTAGC
AGCGACGAGTGTAACGACAACATCATCTTCAGCGAAGAGTACAACACCAG
CAACCCTGATGGAGGTGGCGGATCCGGAGGTGGAGGTTCTGGTGGAGGTG
GGAGTATTCCTCCCCACGTGCAGAAGAGCGTGAATAATGACATGATCGTG
ACCGATAACAATGGCGCCGTGAAATTTCCCCAGCTGTGCAAATTCTGCGA
TGTGAGGTTTTCCACCTGCGACAACCAGAAGTCCTGTATGAGCAACTGCT
CCATCACCTCCATCTGTGAGAAGCCTCAGGAGGTGTGCGTGGCTGTCTGG
CGGAAGAATGACGAGAATATCACCCTGGAAACCGTCTGCCACGATCCCAA
GCTGCCCTACCACGATTTCATCCTGGAAGACGCCGCCAGCCCTAAGTGCA
TCATGAAAGAGAAAAAGAAGCCTGGCGAGACCTTTTTCATGTGCTCCTGC
AGCAGCGACGAATGCAACGACAATATCATCTTTAGCGAGGAATACAATAC
CAGCAACCCCGAC (Human IL-15R α sushi domain)
ATTACATGCCCCCCTCCCATGAGCGTGGAGCACGCCGACATCTGGGTG
AAGAGCTATAGCCTCTACAGCCGGGAGAGGTATATCTGTAACAGCGGCTT
CAAGAGGAAGGCCGGCACCAGCAGCCTCACCGAGTGCGTGCTGAATAAGG
CTACCAACGTGGCTCACTGGACAACACCCTCTTTAAAGTGCATCCGG (Human IL-21)
CAGGGCCAGGACAGGCACATGATCCGGATGAGGCAGCTCATCGACAT
CGTCGACCAGCTGAAGAACTACGTGAACGACCTGGTGCCCGAGTTTCTGC
CTGCCCCCGAGGACGTGGAGACCAACTGCGAGTGGTCCGCCTTCTCCTGC
TTTCAGAAGGCCCAGCTGAAGTCCGCCAACACCGGCAACAACGAGCGGAT
CATCAACGTGAGCATCAAGAAGCTGAAGCGGAAGCCTCCCTCCACAAACG
CCGGCAGGAGGCAGAAGCACAGGCTGACCTGCCCCAGCTGTGACTCCTAC
GAGAAGAAGCCCCCCAAGGAGTTCCTGGAGAGGTTCAAGTCCCTGCTGCA
GAAGATGATCCATCAGCACCTGTCCTCCAGGACCCACGGCTCCGAGGACT
CC
```

The amino acid sequence of TGFRs21 fusion protein (including the leader sequence) is as follows:

```
(Signal peptide)
MKWVTFISLLFLFSSAYS (Human TGFβ Receptor II)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD (Human IL-15R α sushi domain)
ITCPPPMSVEHADIWVKSYSLYSRERYICNSGFKRKAGTSSLTECVLNKA

TNVAHWTTPSLKCIR (Human IL-21)
QGQDRHMIRMRQLIDIVDQLKNYVNDLVPEFLPAPEDVETNCEWSAFSCF

QKAQLKSANTGNNERIINVSIKKLKRKPPSTNAGRRQKHRLTCPSCDSYE

KKPPKEFLERFKSLLQKMIHQHLSSRTHGSEDS
```

In some cases, the leader peptide is cleaved from the intact polypeptide to generate the mature form that may be soluble or secreted.

The TGFR/IL-15RαSu/IL-21 and TGFR/TF/IL-15 constructs were cloned into a modified retrovirus expression vectors as described previously (Hughes M S, Yu Y Y, Dudley M E, Zheng Z, Robbins P F, Li Y, et al. Transfer of a TCR gene derived from a patient with a marked antitumor response conveys highly active T-cell effector functions. *Hum Gene Ther* 2005; 16:457-72), and the expression vectors were transfected into CHO-K1 cells. Co-expression of the two constructs in CHO-K1 cells allowed for formation and secretion of the soluble TGFR/TF/IL-15:TGFR/IL-15RαSu/IL-21 protein complex (referred to as TGFRt15-TGFRs21), which can be purified by anti-TF antibody IgG1 affinity and other chromatography methods.

Purification Elution Chromatograph of TGFRt15-TGFRs21 Using Anti-TF Antibody Affinity Column TGFRt15-TGFRs21 harvested from cell culture was loaded onto the anti-TF antibody affinity column equilibrated with 5 column volumes of PBS. After sample loading, the column was washed with 5 column volumes of PBS, followed by elution with 6 column volumes of 0.1M acetic acid (pH 2.9). A280 elution peak was collected and then neutralized to pH 7.5-8.0 with 1M Tris base. The neutralized sample was then buffer exchanged into PBS using Amicon centrifugal filters with a 30 KDa molecular weight cutoff. As shown in FIG. 134, the anti-TF antibody affinity column bound to TGFRt15-TGFRs21 which contains TF as a fusion partner. The buffer-exchanged protein sample was stored at 2-8° C. for further biochemical analyses and biological activity tests. After each elution, the anti-TF antibody affinity column was stripped using 6 column volumes of 0.1M glycine (pH 2.5). The column was then neutralized using 5 column volumes of PBS, and 7 column volumes of 20% ethanol for storage. The anti-TF antibody affinity column was connected to a GE Healthcare AKTA Avant system. The flow rate was 4 mL/min for all steps except for the elution step, which was 2 mL/min.

Reduced SDS-PAGE analysis of TGFRt15-TGFRs21

To determine the purity and molecular weight of the protein, TGFRt15-TGFRs21 protein sample purified with anti-TF antibody affinity column was analyzed by sodium dodecyl sulfate polyacrylamide gel (4-12% NuPage Bis-Tris gel) electrophoresis (SDS-PAGE) method under reduced condition. After electrophoresis, the gel was stained with InstantBlue for about 30 min, followed by destaining overnight in purified water.

To verify that the TGFRt15-TGFRs21 protein undergoes glycosylation after translation in CHO cells, a deglycosylation experiment was conducted using the Protein Deglycosylation Mix II kit from New England Biolabs and the manufacturer's instructions. FIG. 135 shows the reduced SDS-PAGE analysis of the sample in non-deglycosylated (lane 1) and deglycosylated (lane 2) state. It is clear that the protein is glycosylated when it is expressed in CHO cells. After deglycosylation, the purified sample showed expected molecular weights (69 kDa and 55 kDa) in reduced SDS gel. Lane M was loaded with 10 ul of SeeBlue Plus2 Prestained Standard.

Immunostimulation of TGFRt15-TGFRs21 in C57BL/6 Mice

TGFRt15-TGFRs21 is a multi-chain polypeptide (a type A multi-chain polypeptide described herein) that includes the first polypeptide that is a soluble fusion of single chain two TGFβRII domains, human tissue factor 219 fragment and human IL-15 (TGFRt15), and the second polypeptide that is a soluble fusion of single chain two TGFβRII domains, sushi domain of human IL-15 receptor alpha chain and human IL-21 (TGFRs21).

CHO cells were co-transfected with TGFRt15 and TGFRs21 vectors. The TGFRt15-TGFRs21 complex was purified from the transfected CHO cell culture supernatant. The TGFβ receptor, IL-15, IL-21 and tissue factor (TF) components were demonstrated in the complex by ELISA as shown in FIG. 136. A humanized anti-TF monoclonal antibody (anti-TF IgG1) was used as the capture antibody to determine TF in TGFRt15-TGFRs21, biotinylated anti-human IL-15 antibody (R&D systems), biotinylated anti-human TGFβ receptor antibody (R&D systems), and biotinylated anti-human IL-21 antibody (R&D Systems) were used as the detection antibodies to respectively determine IL-15, TGFβ receptor, and IL-21 in TGFRt15-TGFRs21. For detection, peroxidase conjugated streptavidin (Jackson ImmunoResearch Lab) and ABTS were used.

Wild type C57BL/6 mice were treated subcutaneously with either control solution (PBS) or with TGFRt15-TGFRs21 at 3 mg/kg. Four days after treatment, spleen weight and the percentages of various immune cell types present in the spleen were evaluated. As shown in FIG. 137A, the percentages of CD4$^+$ T cells, CD8$^+$ T cells, and NK cells present in the spleen of control-treated and TGFRt15-TGFRs21-treated mice were evaluated. The dynamic proliferation of immune cells based on Ki67 expression after TGFRt15-TGFRs21 treatment was also evaluated. The splenocytes were stained with fluorochrome-conjugated anti-CD4, anti-CD8, and anti-NK1.1 (NK) antibodies and then intracellularly stained with anti-Ki67 antibody. The percentage of CD4$^+$ T cells, CD8$^+$ T cells, and NK cells and the mean fluorescent intensity (MFI) of Ki67 of corresponding immunocyte subsets were analyzed by flow cytometry (FIGS. 137A and 137B). Furthermore, cytotoxicity potential based on granzyme B expression of the splenocytes induced by TGFRt15-TGFRs21 after the single dose treatment of mouse was also evaluated. As shown in FIG. 138, in the spleens of mice treated with TGFRt15-TGFRs21, the expression of granzyme B by NK cells increased after treatment. The splenocytes from TGFRt15-TGFRs21-treated mice were stained with fluorochrome-conjugated anti-CD4, anti-CD8, and anti-NK1.1 (NK) antibodies and then intracellularly stained with anti-granzyme B antibody. The mean fluorescent intensity (MFI) of granzyme B of corresponding immunocyte subsets was analyzed by flow cytometry (FIG. 138).

As shown in FIG. 137A, in the spleens of mice treated with TGFRt15-TGFRs21, the percentages of CD8$^+$ T cells and NK cells both increased on day 4 after a single TGFRt15-TGFRs21 treatment. These results demonstrate that TGFRt15-TGFRs21 is able to induce immune cells to proliferate in mouse spleen, in particular CD8$^+$ T cells and NK cells.

Additionally, cytotoxicity of the mouse splenocytes against tumor cells was also evaluated. Mouse Yac-1 cells were labeled with CellTrace Violet and used as tumor target cells. The splenocytes were prepared from TGFRt15-TGFRs21-treated mice and used as effector cells. The target cells were mixed with effector cells at E:T ratio=10:1 in RPMI-10 medium with or without TGFRt15-TGFRs21 at 100 nM and incubated at 37° C. for 24 hours. Target Yac-1 cell inhibition was assessed by analysis of viable CellTrace Violet-labeled Yac-1 cells using flow cytometry. Percentage of Yac-1 inhibition was calculated using a formula, (1−[viable Yac-1 cell number in experimental sample]/[viable Yac-1 cell number in the sample without splenocytes])×100. As shown in FIG. 139, TGFRt15-TGFRs21-treated mouse splenocytes had stronger cytotoxicity against Yac-1 cells than the control mouse cells in the presence of TGFRt15-TGFRs21 during cytotoxic assay (FIG. 139).

Example 59: TGFRt15-TGFRs16 Fusion Protein Generation

A fusion protein complex was generated comprising of TGFβ Receptor II/IL-15RαSu/anti-CD16scFv and TGFβ Receptor II/TF/IL-15 fusion proteins (FIG. 140 and FIG. 141). The human TGFβ Receptor II (Ile24-Asp159), tissue factor 219, and IL-15 sequences were obtained from the UniProt website and DNA for these sequences was synthesized by Genewiz. Specifically, a construct was made linking two TGFβ Receptor II sequences with a G4S(3) linker to generate a single chain version of TGFβ Receptor II and then directly linking to the N-terminus coding region of tissue factor 219 followed by the N-terminus coding region of IL-15.

The nucleic acid and protein sequences of a construct comprising two TGFβ Receptor II linked to the N-terminus of tissue factor 219 following with the N-terminus of IL-15 are shown below.

The nucleic acid sequence of the TGFRt15 construct (including signal peptide sequence) is as follows:

(Signal peptide)
ATGAAGTGGGTGACCTTCATCAGCCTGCTGTTCCTGTTCTCCAGCGCCT

ACTCC (Human TGFβ Receptor II fragments)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCAGCA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG

CAACCCTGATGGAGGTGGCGGATCCGGAGGTGGAGGTTCTGGTGGAGGTG

GGAGTATTCCTCCCCACGTGCAGAAGAGCGTGAATAATGACATGATCGTG

ACCGATAACAATGGCGCCGTGAAATTTCCCCAGCTGTGCAAATTCTGCGA

TGTGAGGTTTTCCACCTGCGACAACCAGAAGTCCTGTATGAGCAACTGCT

CCATCACCTCCATCTGTGAGAAGCCTCAGGAGGTGTGCGTGGCTGTCTGG

CGGAAGAATGACGAGAATATCACCCTGGAAACCGTCTGCCACGATCCCAA

GCTGCCCTACCACGATTTCATCCTGGAAGACGCCGCCAGCCCTAAGTGCA

TCATGAAAGAGAAAAAGAAGCCTGGCGAGACCTTTTTCATGTGCTCCTGC

AGCAGCGACGAATGCAACGACAATATCATCTTTAGCGAGGAATACAATAC

CAGCAACCCCGAC (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGCACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC

The amino acid sequence of TGFRt15 fusion protein (including the leader sequence) is as follows:

(Signal peptide)
MKWVTFISLLFLFSSAYS (Human TGFβ Receptor II)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD (Human Tissue Factor 219)
SGTTNTVAAYNLTWKSTNFKTILEWEPKPVNQVYTVQISTKSGDWKSKC

FYTTDTECDLTDEIVKDVKQTYLARVFSYPAGNVESTGSAGEPLYENSPE

FTPYLETNLGQPTIQSFEQVGTKVNVTVEDERTLVRRNNTFLSLRDVFGK

DLIYTLYYWKSSSSGKKTAKTNTNEFLIDVDKGENYCFSVQAVIPSRTVN

RKSTDSPVECMGQEKGEFRE (Human IL-15)
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS

Constructs were also made by attaching two TGFβ Receptor II directly to the IL-15RαSu chain, followed by the anti-CD16scFv sequence, which was synthesized by Genewiz. The nucleic acid and protein sequences of a construct comprising the TGFβ Receptor II linked to the N-terminus of IL-15RαSu following with the anti-CD16scFv sequence are shown below.

The nucleic acid sequence of the TGFRs16 construct (including signal peptide sequence) is as follows:

(Signal peptide)
ATGAAGTGGGTGACCTTCATCAGCCTGCTGTTCCTGTTCTCCAGCGCCT

ACTCC (Human TGFβ Receptor II fragments)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCAGCA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG

CAACCCTGATGGAGGTGGCGGATCCGGAGGTGGAGGTTCTGGTGGAGGTG

GGAGTATTCCTCCCCACGTGCAGAAGAGCGTGAATAATGACATGATCGTG

ACCGATAACAATGGCGCCGTGAAATTTCCCCAGCTGTGCAAATTCTGCGA

TGTGAGGTTTTCCACCTGCGACAACCAGAAGTCCTGTATGAGCAACTGCT

-continued

CCATCACCTCCATCTGTGAGAAGCCTCAGGAGGTGTGCGTGGCTGTCTGG

CGGAAGAATGACGAGAATATCACCCTGGAAACCGTCTGCCACGATCCCAA

GCTGCCCTACCACGATTTCATCCTGGAAGACGCCGCCAGCCCTAAGTGCA

TCATGAAAGAGAAAAAGAAGCCTGGCGAGACCTTTTTCATGTGCTCCTGC

AGCAGCGACGAATGCAACGACAATATCATCTTTAGCGAGGAATACAATAC

CAGCAACCCCGAC (Human IL-15R α sushi domain)
ATTACATGCCCCCCTCCCATGAGCGTGGAGCACGCCGACATCTGGGTG

AAGAGCTATAGCCTCTACAGCCGGGAGAGGTATATCTGTAACAGCGGCTT

CAAGAGGAAGGCCGGCACCAGCAGCCTCACCGAGTGCGTGCTGAATAAGG

CTACCAACGTGGCTCACTGGACAACACCCTCTTTAAAGTGCATCCGG (Anti-human CD16scFv)
TCCGAGCTGACCCAGGACCCTGCTGTGTCCGTGGCTCTGGGCCAGACC

GTGAGGATCACCTGCCAGGGCGACTCCCTGAGGTCCTACTACGCCTCCTG

GTACCAGCAGAAGCCCGGCCAGGCTCCTGTGCTGGTGATCTACGGCAAGA

ACAACAGGCCCTCCGGCATCCCTGACAGGTTCTCCGGATCCTCCTCCGGC

AACACCGCCTCCCTGACCATCACAGGCGCTCAGGCCGAGGACGAGGCTGA

CTACTACTGCAACTCCAGGGACTCCTCCGGCAACCATGTGGTGTTCGGCG

GCGGCACCAAGCTGACCGTGGGCCATGGCGGCGGCGGCTCCGGAGGCGGC

GGCAGCGGCGGAGGAGGATCCGAGGTGCAGCTGGTGGAGTCCGGAGGAGG

AGTGGTGAGGCCTGGAGGCTCCCTGAGGCTGAGCTGTGCTGCCTCCGGCT

TCACCTTCGACGACTACGGCATGTCCTGGGTGAGGCAGGCTCCTGGAAAG

GGCCTGGAGTGGGTGTCCGGCATCAACTGGAACGGCGGATCCACCGGCTA

CGCCGATTCCGTGAAGGGCAGGTTCACCATCAGCAGGGACAACGCCAAGA

ACTCCCTGTACCTGCAGATGAACTCCCTGAGGGCCGAGGACACCGCCGTG

TACTACTGCGCCAGGGGCAGGTCCCTGCTGTTCGACTACTGGGGACAGGG

CACCCTGGTGACCGTGTCCAGG

The amino acid sequence of TGFRs16 fusion protein (including the leader sequence) is as follows:

(Signal peptide)
MKWVTFISLLFLFSSAYS (Human TGFβ Receptor II)
IPPHVQKSVNNDMIVTDNNGAVKFPQLCKFCDVRFSTCDNQKSCMSNCSI

TSICEKPQEVCVAVWRKNDENITLETVCHDPKLPYHDFILEDAASPKCIM

KEKKKPGETFFMCSCSSDECNDNIIFSEEYNTSNPDGGGGSGGGGSGGGG

SIPPHVQKSVNNDMIVTDNNGAVKFPQLCKFCDVRFSTCDNQKSCMSNCS

ITSICEKPQEVCVAVWRKNDENITLETVCHDPKLPYHDFILEDAASPKCI

MKEKKKPGETFFMCSCSSDECNDNIIFSEEYNTSNPD (Human IL-15R α sushi domain)
ITCPPPMSVEHADIWVKSYSLYSRERYICNSGFKRKAGTSSLTECVLNKA

TNVAHWTTPSLKCIR (Anti-human CD16scFv)
SELTQDPAVSVALGQTVRITCQGDSLRSYYASWYQQKPGQAPVLVIYGK

NNRPSGIPDRFSGSSSGNTASLTITGAQAEDEADYYCNSRDSSGNHVVFG

GGTKLTVGHGGGGSGGGGSGGGGSEVQLVESGGGVVRPGGSLRLSCAASG

FTFDDYGMSWVRQAPGKGLEWVSGINWNGGSTGYADSVKGRFTISRDNAK

NSLYLQMNSLRAEDTAVYYCARGRSLLFDYWGQGTLVTVSR

In some cases, the leader peptide is cleaved from the intact polypeptide to generate the mature form that may be soluble or secreted.

The TGFR/IL-15RαSu/anti-CD16scFv and TGFR/TF/IL-15 constructs were cloned into a modified retrovirus expression vectors as described previously (Hughes M S, Yu Y Y, Dudley M E, Zheng Z, Robbins P F, Li Y, et al. Transfer of a TCR gene derived from a patient with a marked antitumor response conveys highly active T-cell effector functions. Hum Gene Ther 2005; 16:457-72), and the expression vectors were transfected into CHO-K1 cells. Co-expression of the two constructs in CHO-K1 cells allowed for formation and secretion of the soluble TGFR/TF/IL-15:TGFR/IL-15RαSu/anti-CD16scFv protein complex (referred to as TGFRt15-TGFRs16), which can be purified by anti-TF IgG1 affinity and other chromatography methods.

Example 60: The TGFRt15-TGFRs137L Fusion Protein Generation

A fusion protein complex was generated comprising of TGFβ Receptor II/IL-15RαSu/CD137L and TGFβ Receptor II/TF/IL-15 fusion proteins (FIG. 142 and FIG. 143). The human TGFβ Receptor II (Ile24-Asp159), tissue factor 219, CD137L, and IL-15 sequences were obtained from the UniProt website and DNA for these sequences was synthesized by Genewiz. Specifically, a construct was made linking two TGF Receptor II sequences with a G4S(3) linker to generate a single chain version of TGFβ Receptor II and then directly linking to the N-terminus coding region of tissue factor 219 followed by the N-terminus coding region of IL-15.

The nucleic acid and protein sequences of a construct comprising two TGFβ Receptor II linked to the N-terminus of tissue factor 219 following with the N-terminus of IL-15 are shown below.

The nucleic acid sequence of the TGFRt15 construct (including signal peptide sequence) is as follows:

(Signal peptide)
ATGAAGTGGGTGACCTTCATCAGCCTGCTGTTCCTGTTCTCCAGCGCCT

ACTCC (Human TGFβ Receptor II fragments)
ATCCCCCCCCATGTGCAAAAGAGCGTGAACAACGATATGATCGTGACC

GACAACAACGGCGCCGTGAAGTTTCCCCAGCTCTGCAAGTTCTGCGATGT

CAGGTTCAGCACCTGCGATAATCAGAAGTCCTGCATGTCCAACTGCAGCA

TCACCTCCATCTGCGAGAAGCCCCAAGAAGTGTGCGTGGCCGTGTGGCGG

AAAAATGACGAGAACATCACCCTGGAGACCGTGTGTCACGACCCCAAGCT

CCCTTATCACGACTTCATTCTGGAGGACGCTGCCTCCCCCAAATGCATCA

TGAAGGAGAAGAAGAAGCCCGGAGAGACCTTCTTTATGTGTTCCTGTAGC

AGCGACGAGTGTAACGACAACATCATCTTCAGCGAAGAGTACAACACCAG

CAACCCTGATGGAGGTGGCGGATCCGGAGGTGGAGGTTCTGGTGGAGGTG

GGAGTATTCCTCCCCACGTGCAGAAGAGCGTGAATAATGACATGATCGTG

ACCGATAACAATGGCGCCGTGAAATTTCCCCAGCTGTGCAAATTCTGCGA

TGTGAGGTTTTCCACCTGCGACAACCAGAAGTCCTGTATGAGCAACTGCT

CCATCACCTCCATCTGTGAGAAGCCTCAGGAGGTGTGCGTGGCTGTCTGG

CGGAAGAATGACGAGAATATCACCCTGGAAACCGTCTGCCACGATCCCAA

GCTGCCCTACCACGATTTCATCCTGGAAGACGCCGCCAGCCCTAAGTGCA

TCATGAAAGAGAAAAAGAAGCCTGGCGAGACCTTTTTCATGTGCTCCTGC

AGCAGCGACGAATGCAACGACAATATCATCTTTAGCGAGGAATACAATAC

CAGCAACCCCGAC (Human Tissue Factor 219)
AGCGGCACAACCAACACAGTCGCTGCCTATAACCTCACTTGGAAGAG

CACCAACTTCAAAACCATCCTCGAATGGGAACCCAAACCCGTTAACCAAG

TTTACACCGTGCAGATCAGCACCAAGTCCGGCGACTGGAAGTCCAAATGT

TTCTATACCACCGACACCGAGTGCGATCTCACCGATGAGATCGTGAAAGA

TGTGAAACAGACCTACCTCGCCCGGGTGTTTAGCTACCCCGCCGGCAATG

TGGAGAGCACTGGTTCCGCTGGCGAGCCTTTATACGAGAACAGCCCCGAA

TTTACCCCTTACCTCGAGACCAATTTAGGACAGCCCACCATCCAAAGCTT

TGAGCAAGTTGGCACAAAGGTGAATGTGACAGTGGAGGACGAGCGGACTT

TAGTGCGGCGGAACAACACCTTTCTCAGCCTCCGGGATGTGTTCGGCAAA

GATTTAATCTACACACTGTATTACTGGAAGTCCTCTTCCTCCGGCAAGAA

GACAGCTAAAACCAACACAAACGAGTTTTTAATCGACGTGGATAAAGGCG

AAAACTACTGTTTCAGCGTGCAAGCTGTGATCCCCTCCCGGACCGTGAAT

AGGAAAAGCACCGATAGCCCCGTTGAGTGCATGGGCCAAGAAAAGGGCGA

GTTCCGGGAG (Human IL-15)
AACTGGGTGAACGTCATCAGCGATTTAAAGAAGATCGAAGATTTAATT

CAGTCCATGCATATCGACGCCACTTTATACACAGAATCCGACGTGCACCC

CTCTTGTAAGGTGACCGCCATGAAATGTTTTTTACTGGAGCTGCAAGTTA

TCTCTTTAGAGAGCGGAGACGCTAGCATCCACGACACCGTGGAGAATTTA

ATCATTTTAGCCAATAACTCTTTATCCAGCAACGGCAACGTGACAGAGTC

CGGCTGCAAGGAGTGCGAAGAGCTGGAGGAGAAGAACATCAAGGAGTTTC

TGCAATCCTTTGTGCACATTGTCCAGATGTTCATCAATACCTCC

The amino acid sequence of TGFRt15 fusion protein (including the leader sequence) is as follows:

(Signal peptide)
MKWVTFISLLFLFSSAYS (Human TGFβ Receptor II)
IPPHVQKSVNNDMIVTDNNGAVKFPQLCKFCDVRFSTCDNQKSCMSNCS
ITSICEKPQEVCVAVWRKNDENITLETVCHDPKLPYHDFILEDAASPKC
IMKEKKKPGETFFMCSCSSDECNDNIIFSEEYNTSNPDGGGGSGGGGSG -continued
```
GGGSIPPHVQKSVNNDMIVTDNNGAVKFPQLCKFCDVRFSTCDNQKSCM
SNCSITSICEKPQEVCVAVWRKNDENITLETVCHDPKLPYHDFILEDAA
SPKCIMKEKKKPGETFFMCSCSSDECNDNIIFSEEYNTSNPD (Human Tissue Factor 219)
SGTTNTVAAYNLTWKSTNFKTILEWEPKPVNQVYTVQISTKSGDWKSKC
FYTTDTECDLTDEIVKDVKQTYLARVFSYPAGNVESTGSAGEPLYENSP
EFTPYLETNLGQPTIQSFEQVGTKVNVTVEDERTLVRRNNTFLSLRDVF
GKDLIYTLYYWKSSSSGKKTAKTNTNEFLIDVDKGENYCFSVQAVIPSR
TVNRKSTDSPVECMGQEKGEFRE (Human IL-15)
NWVNVISDLKKIEDLIQSMHIDATLYTESDVHPSCKVTAMKCFLLELQV
ISLESGDASIHDTVENLIILANNSLSSNGNVTESGCKECEELEEKNIKE
FLQSFVHIVQMFINTS
```

Constructs were also made by attaching two TGFβ Receptor II directly to the IL-15RαSu chain, followed by a (G4S)3 linker and the CD137L sequence, which was synthesized by Genewiz. The nucleic acid and protein sequences of a construct comprising the TGFβ Receptor II linked to the N-terminus of IL-15RαSu following with a (G4S)3 linker and the CD137L sequence are shown below.

The nucleic acid sequence of the TGFRs137L construct (including signal peptide sequence) is as follows:

```
(Signal peptide)
ATGAAGTGGGTGACCTTCATCAGCCTGCTGTTCCTGTTCTCCAGCGCCT
ACTCC (Human TGFβ Receptor II fragments)
ATCCCCCCCCATGTGCAAAAGAGCGTGAACAACGATATGATCGTGACCG
ACAACAACGGCGCCGTGAAGTTTCCCCAGCTCTGCAAGTTCTGCGATGT
CAGGTTCAGCACCTGCGATAATCAGAAGTCCTGCATGTCCAACTGCAGC
ATCACCTCCATCTGCGAGAAGCCCCAAGAAGTGTGCGTGGCCGTGTGGC
GGAAAAATGACGAGAACATCACCCTGGAGACCGTGTGTCACGACCCCAA
GCTCCCTTATCACGACTTCATTCTGGAGGACGCTGCCTCCCCCAAATGC
ATCATGAAGGAGAAGAAGAAGCCCGGAGAGACCTTCTTTATGTGTTCCT
GTAGCAGCGACGAGTGTAACGACAACATCATCTTCAGCGAAGAGTACAA
CACCAGCAACCCTGATGGAGGTGGCGGATCCGGAGGTGGAGGTTCTGGT
GGAGGTGGGAGTATTCCTCCCCACGTGCAGAAGAGCGTGAATAATGACA
TGATCGTGACCGATAACAATGGCGCCGTGAAATTTCCCCAGCTGTGCAA
ATTCTGCGATGTGAGGTTTTCCACCTGCGACAACCAGAAGTCCTGTATG
AGCAACTGCTCCATCACCTCCATCTGTGAGAAGCCTCAGGAGGTGTGCG
TGGCTGTCTGGCGGAAGAATGACGAGAATATCACCCTGGAAACCGTCTG
CCACGATCCCAAGCTGCCCTACCACGATTTCATCCTGGAAGACGCCGCC
AGCCCTAAGTGCATCATGAAAGAGAAAAAGAAGCCTGGCGAGACCTTTT
TCATGTGCTCCTGCAGCAGCGACGAATGCAACGACAATATCATCTTTAG
CGAGGAATACAATACCAGCAACCCCGAC (Human IL-15R α sushi domain)
ATTACATGCCCCCCTCCCATGAGCGTGGAGCACGCCGACATCTGGGTGA
AGAGCTATAGCCTCTACAGCCGGGAGAGGTATATCTGTAACAGCGGCTT
CAAGAGGAAGGCCGGCACCAGCAGCCTCACCGAGTGCGTGCTGAATAAG
GCTACCAACGTGGCTCACTGGACAACACCCTCTTTAAAGTGCATCCGG ((G4S)3 linker)
GGCGGTGGAGGATCCGGAGGAGGTGGCTCCGGCGGCGGAGGATCT (Human CD137L)
CGCGAGGGTCCCGAGCTTTCGCCCGACGATCCCGCCGGCCTCTTGGACC
TGCGGCAGGGCATGTTTGCGCAGCTGGTGGCCCAAAATGTTCTGCTGAT
CGATGGGCCCTGAGCTGGTACAGTGACCCAGGCCTGGCAGGCGTGTCC
CTGACGGGGGGCCTGAGCTACAAAGAGGACACGAAGGAGCTGGTGGTGG
CCAAGGCTGGAGTCTACTATGTCTTCTTTCAACTAGAGCTGCGGCGCGT
GGTGGCCGGCGAGGGCTCAGGCTCCGTTTCACTTGCGCTGCACCTGCAG
CCACTGCGCTCTGCTGCTGGGGCCGCCGCCCTGGCTTTGACCGTGGACA
TGCCACCCGCCTCCTCCGAGGCTCGGAACTCGGCCTTCGGTTTCCAGGG
CCGCTTGCTGCACCTGAGTGCCGGCCAGCGCCTGGGCGTCCATCTTCAC
ACTGAGGCCAGGGCACGCCATGCCTGGCAGCTTACCCAGGGCGCCACAG
TCTTGGGACTCTTCCGGGTGACCCCCGAAATCCCAGCCGGACTCCCTTC
ACCGAGGTCGGAA
```

The amino acid sequence of TGFRs137L fusion protein (including the leader sequence) is as follows:

```
(Signal peptide)
MKWVTFISLLFLFSSAYS (Human TGFβ Receptor II)
IPPHVQKSVNNDMIVTDNNGAVKFPQLCKFCDVRFSTCDNQKSCMSNCS
ITSICEKPQEVCVAVWRKNDENITLETVCHDPKLPYHDFILEDAASPKC
IMKEKKKPGETFFMCSCSSDECNDNIIFSEEYNTSNPDGGGGSGGGGSG
GGGSIPPHVQKSVNNDMIVTDNNGAVKFPQLCKFCDVRFSTCDNQKSCM
SNCSITSICEKPQEVCVAVWRKNDENITLETVCHDPKLPYHDFILEDAA
SPKCIMKEKKKPGETFFMCSCSSDECNDNIIFSEEYNTSNPD (Human IL-15R α sushi domain)
ITCPPPMSVEHADIWVKSYSLYSRERYICNSGFKRKAGTSSLTECVLNK
ATNVAHWTTPSLKCIR ((G4S)3 linker)
GGGGSGGGGSGGGGS (Human CD137L)
REGPELSPDDPAGLLDLRQGMFAQLVAQNVLLIDGPLSWYSDPGLAGVS
LTGGLSYKEDTKELVVAKAGVYYVFFQLELRRVVAGEGSGSVSLALHLQ
PLRSAAGAAALALTVDLPPASSEARNSAFGFQGRLLHLSAGQRLGVHLH
TEARARHAWQLTQGATVLGLFRVTPEIPAGLPSPRSE
```

In some cases, the leader peptide is cleaved from the intact polypeptide to generate the mature form that may be soluble or secreted.

The TGFR/IL-15RαSu/CD137L and TGFR/TF/IL-15 constructs were cloned into a modified retrovirus expression vectors as described previously (Hughes M S, Yu Y Y, Dudley M E, Zheng Z, Robbins P F, Li Y, et al. Transfer of a TCR gene derived from a patient with a marked antitumor response conveys highly active T-cell effector functions. *Hum Gene Ther* 2005; 16:457-72), and the expression vectors were transfected into CHO-K1 cells. Co-expression of the two constructs in CHO-K1 cells allowed for formation and secretion of the soluble TGFR/TF/IL-15:TGFR/IL-15RαSu/CD137L protein complex (referred to as TGFRt15-TGFRs137L), which can be purified by anti-TF IgG1 affinity and other chromatography methods.

Example 61. Production and Characterization of the Exemplary Single-Chain Chimeric Polypeptide 2t2

An exemplary single-chain chimeric polypeptide including a first target-binding domain that binds to an IL-2 receptor, a soluble human tissue factor domain, and a second target-binding domain that binds to an IL-2 receptor was generated (IL-2/TF/IL-2; referred to as 2t2) (FIG. 144). The nucleic acid and amino acid sequences of this single-chain chimeric polypeptide are shown below.

Nucleic Acid Encoding Exemplary Single-Chain Chimeric Polypeptide (IL-2/TF/IL-2) (SEQ ID NO: 164)

```
(Signal peptide)
ATGAAGTGGGTGACCTTCATCAGCCTGCTGTTCCTGTTCTCCAGCGCCT
ACTCC (First IL-2 fragment)
GCCCCCACCTCCTCCTCCACCAAGAAGACCCAGCTGCAGCTGGAGCATT
TACTGCTGGATTTACAGATGATTTTAAACGGCATCAACAACTACAAGAA
CCCCAAGCTGACTCGTATGCTGACCTTCAAGTTCTACATGCCCAAGAAG
GCCACCGAGCTGAAGCATTTACAGTGTTTAGAGGAGGAGCTGAAGCCCC
TCGAGGAGGTGCTGAATTTAGCCCAGTCCAAGAATTTCCATTTAAGGCC
CCGGGATTTAATCAGCAACATCAACGTGATCGTTTTAGAGCTGAAGGGC
TCCGAGACCACCTTCATGTGCGAGTACGCCGACGAGACCGCCACCATCG
TGGAGTTTTTAAATCGTTGGATCACCTTCTGCCAGTCCATCATCTCCAC
TTTAACC
```

-continued (Human tissue factor 219 form)
AGCGGCACAACCAACACAGTCGCTGCCTATAACCTCACTTGGAAGAGCA
CCAACTTCAAAACCATCCTCGAATGGGAACCCAAACCCGTTAACCAAGT
TTACACCGTGCAGATCAGCACCAAGTCCGGCGACTGGAAGTCCAAATGT
TTCTATACCACCGACACCGAGTGCGATCTCACCGATGAGATCGTGAAAG
ATGTGAAACAGACCTACCTCGCCGGGTGTTTAGCTACCCCGCCGGCAA
TGTGGAGAGCACTGGTTCCGCTGGCGAGCCTTTATACGAACAGCCCC
GAATTTACCCCTTACCTCGAGACCAATTTAGGACAGCCCACCATCCAAA
GCTTTGAGCAAGTTGGCACAAAGGTGAATGTGACAGTGGAGGACGAGCG
GACTTTAGTGCGGCGGAACAACACCTTTCTCAGCCTCCGGGATGTGTTC
GGCAAAGATTTAATCTACACACTGTATTACTGGAAGTCCTCTTCCTCCG
GCAAGAAGACAGCTAAAACCAACACAAACGAGTTTTTAATCGACGTGGA
TAAAGGCGAAAACTACTGTTTCAGCGTGCAAGCTGTGATCCCCTCCCGG
ACCGTGAATAGGAAAAGCACCGATAGCCCCGTTGAGTGCATGGGCCAAG
AAAAGGGCGAGTTCCGGGAG (Second IL-2 fragment)
GCACCTACTTCAAGTTCTACAAAGAAAACACAGCTACAACTGGAGCATT
TACTGCTGGATTTACAGATGATTTTGAATGGAATTAATAATTACAAGAA
TCCCAAACTCACCAGGATGCTCACATTTAAGTTTTACATGCCCAAGAAG
GCCACAGAACTGAAACATCTTCAGTGTCTAGAAGAAGAACTCAAACCTC
TGGAGGAAGTGCTAAATTTAGCTCAAAGCAAAAACTTTCACTTAAGACC
CAGGGACTTAATCAGCAATATCAACGTAATAGTTCTGGAACTAAAGGGA
TCTGAAACAACATTCATGTGTGAATATGCTGATGAGACAGCAACCATTG
TAGAATTTCTGAACAGATGGATTACCTTTTGTCAAAGCATCATCTCAAC
ACTAACT Exemplary Single-Chain Chimeric Polypeptide (IL-2/TF/IL-2) (SEQ ID NO: 163)

(Signal peptide)
MKWVTFISLLFLFSSAYS (Human IL-2)
APTSSSTKKTQLQLEHLLLDLQMILNGINNYKNPKLTRMLTFKFYMPKK
ATELKHLQCLEEELKPLEEVLNLAQSKNFHLRPRDLISNINVIVLELKG
SETTFMCEYADETATIVEFLNRWITFCQSIISTLT (Human Tissue Factor 219)
SGTTNTVAAYNLTWKSTNFKTILEWEPKPVNQVYTVQISTKSGDWKSKC
FYTTDTECDLTDEIVKDVKQTYLARVFSYPAGNVESTGSAGEPLYENSP
EFTPYLETNLGQPTIQSFEQVGTKVNVTVEDERTLVRRNNTFLSLRDVF
GKDLIYTLYYWKSSSSGKKTAKTNTNEFLIDVDKGENYCFSVQAVIPSR
TVNRKSTDSPVECMGQEKGEFRE (Human IL-2)
APTSSSTKKTQLQLEHLLLDLQMILNGINNYKNPKLTRMLTFKFYMPKK
ATELKHLQCLEEELKPLEEVLNLAQSKNFHLRPRDLISNINVIVLELKG
SETTFMCEYADETATIVEFLNRWITFCQSIISTLT The nucleic acid encoding IL-2/TF/IL-2 was cloned into a modified retrovirus expression vector as described previously (Hughes et al., *Hum Gene Ther* 16:457-72, 2005). The expression vector encoding IL-2/TF/IL-2 was transfected into CHO-K1 cells. Expression of the expression vector in CHO-K1 cells allowed for secretion of the soluble IL-2/TF/IL-2 single-chain chimeric polypeptide (referred to as 2t2), which can be purified by anti-TF antibody affinity and other chromatography methods.

IL-2 and 2t2 Promoted IL-2Rβ and Common γ Chain Containing 32Dβ Cell Proliferation in a Similar Manner To evaluate the IL-2 activity of 2t2, 2t2 was compared with recombinant IL-2 for promoting proliferation of 32Dβ cells that express IL-2Rβ and common γ chain. IL-2 dependent 321143 cells were washed 5 times with IMDM-10% FBS and seeded to the wells at $2\times10^4$ cells/well. Serial dilutions of 2t2 or IL-2 were added to the cells (FIG. 145). Cells were incubated in a $CO_2$ incubator at 37° C. for 3 days. Cell proliferation was detected by adding 10 µl of WST1 to each well on day 3 and incubating for an additional 3 hours in a $CO_2$ incubator at 37° C. The amount of formazan dye produced was analyzed by measuring the absorbance at 450 nm. As shown in FIG. 145, 2t2 and IL-2 activated 32Dβ cells in a similar manner. The $EC_{50}$ of 2t2 and IL-2 was 158.1 pM and 140 pM. respectively.

2t2 Showed Improved Ability to Promote IL-2Rαβγ Containing CTLL-2 Cell Proliferation as Compared to IL-2

To evaluate the IL-2 activity of 2t2, 2t2 was compared with recombinant IL-2 for promoting proliferation of CTLL-2 cells that express IL-2Rα, IL-2Rβ and common chain. IL-2 dependent CTLL-2 cells were washed 5 times with IMDM-10% FBS and seeded to the wells at $2\times10^4$ cells/well. Serial dilutions of 2t2 or IL-2 were added to the cells (FIG. 146). Cells were incubated in a $CO_2$ incubator at 37° C. for 3 days. Cell proliferation was detected by adding 10 µl of WST1 to each well in the day 3 and incubating for an additional 3 hours in a $CO_2$ incubator at 37° C. The amount of formazan dye produced was analyzed by measuring the absorbance at 450 nm. As shown in FIG. 146, 2t2 promoted CTLL-2 cell proliferation 4-5-fold stronger than IL-2. The $EC_{50}$ of 2t2 was 123.2 pM and IL-2 was 548.2 pM.

2t2 Suppressed the Increase of the High Fat-Induced Hyperglycemia in ApoE$^{-/-}$ Mice Six-week-old female ApoE$^{-/-}$ mice (Jackson Lab) were fed with standard chow diet or high diet fat containing 21% fat, 0.15% cholesterol, 34.1% sucrose, 19.5% casein, and 15% starch (TD88137, Harlan Laboratories) and maintained in the standard conditions. At week 7, mice fed with high fat diet were randomly assigned into the control group and treatment group. Mice then received either 2t2 (treatment group) or PBS (chow diet group and control group) per subcutaneous injection at a dosage of 3 mg/kg. Three days post dosing, the mice were fasted overnight, and blood samples were collected through retro-orbital venous plexus puncture. Overnight fasting glucose levels were measured using a OneTouch Glucometer. As shown in FIG. 147, the results showed that 2t2 injection effectively suppresses the increase of glucose levels in ApoE$^{-/-}$ mice.

2t2 Significantly Upregulate the Ratio of CD4$^+$CD25$^+$ FoxP3$^+$ T Regulatory (Treg) Cells in Blood Lymphocytes Six-week-old female ApoE$^{-/-}$ mice (Jackson Lab) were fed with standard chow diet or high diet fat containing 21% fat, 0.15% cholesterol, 34.1% sucrose, 19.5% casein, and 15% starch (TD88137, Harlan Laboratories) and maintained in the standard conditions. At week 7, mice fed with the high fat diet were randomly assigned into control group and treatment group. Mice then received either 2t2 (treatment group) or PBS (chow diet group and control group) per subcutaneous injection at a dosage of 3 mg/kg. Three days after the dosing, overnight fasting blood samples were collected through retro-orbital venous plexus puncture and incubated with ACK lysing buffer (Thermo Fisher Scientific) at 37° C. for 5 minutes. Samples were then resuspended in FACS buffer (1×PBS (Hyclone) with 0.5% BSA (EMD Millipore) and 0.001% sodium azide (Sigma)) and surface stained with FITC-anti-CD4 and APC-anti-CD25 antibodies (BioLegend) for 30 minutes. Surface-stained samples were further fixed and premetallized with Fix/Perm buffer (BioLegend) and intracellular stained with PE-anti-Foxp3 antibody (BioLegend). After staining, cells were washed twice with FACs buffer followed by centrifugation at 1500 RPM for 5 minutes at room temperature. The cells were analyzed by flow cytometry (Celesta-BD Bioscience). As shown in FIG. 148, 2t2 treatment significantly increased Treg populations in blood lymphocytes (3.5%±0.32) compared to the untreated groups (0.4%±0.16 for chow diet group and 0.46%±0.09 for high fat diet group).

Purification Elution Chromatograph of 2t2 from Anti-TF Antibody Affinity Column

2t2 harvested from cell culture was loaded onto the anti-TF antibody affinity column equilibrated with 5 column volumes of PBS. After sample loading, the column was washed with 5 column volumes of PBS, followed by elution with 6 column volumes of 0.1M acetic acid, pH 2.9. A280 elution peak was collected and then neutralized to pH 7.5-8.0 with 1M Tris base. The neutralized sample was then buffer exchanged into PBS using Amicon centrifugal filters with a 30 kDa molecular weight cutoff. As shown in FIG. 149, the anti-TF antibody affinity column bound to 2t2 which contains TF as a fusion domain. The buffer-exchanged protein sample was stored at 2-8° C. for further biochemical analyses and biological activity tests. After each elution, the anti-TF antibody affinity column was stripped using 6 column volumes of 0.1M glycine, pH 2.5. The column was then neutralized using 5 column volumes of PBS, and 7 column volumes of 20% ethanol for storage. The anti-TF antibody affinity column was connected to a GE Healthcare AKTA Avant system. The flow rate was 4 mL/min for all steps except for the elution step, which was 2 mL/min.

Analytical Size Exclusion Chromatography (SEC) Analysis of 2t2

To analyze 2t2 using analytical size exclusion chromatography (SEC), a Superdex 200 Increase 10/300 GL gel filtration column (from GE Healthcare) was connected to an AKTA Avant system (from GE Healthcare). The column was equilibrated with 2 column volumes of PBS. The flow rate was 0.7 mL/min. A sample containing 2t2 in PBS was injected into the Superdex 200 column using a capillary loop, and analyzed by SEC. The SEC chromatograph of the sample is shown in FIG. 150. The SEC results indicated two protein peaks for 2t2.

Reduced SDS-PAGE of 2t2

To determine the purity and molecular weight of the protein, 2t2 protein sample purified with anti-TF antibody affinity column was analyzed by sodium dodecyl sulfate polyacrylamide gel (4-12% NuPage Bis-Tris gel) electrophoresis (SDS-PAGE) method under reduced condition. After electrophoresis, the gel was stained with InstantBlue for about 30 min, followed by destaining overnight in purified water.

To verify that the 2t2 protein undergoes glycosylation after translation in CHO cells, a deglycosylation experiment was conducted using the Protein Deglycosylation Mix II kit from New England Biolabs according to the manufacturer's instructions. FIGS. 151A and 151B show the reduced SDS-PAGE analysis of the sample in non-deglycosylated (lane 1) and deglycosylated (lane 2) state. The results show that the 2t2 protein is glycosylated when expressed in CHO cells. After deglycosylation, the purified sample ran with expected molecular weights (56 kDa) in reduced SDS gel. Lane M was loaded with 10 μL of SeeBlue Plus2 Prestained Standard.

In Vivo Characterization of 2t2

2t2 was subcutaneously injected into C57BL/6 mice at various doses to determine the immunostimulatory activity of 2t2 in vivo. Mice were subcutaneously treated with control solution (PBS) or 2t2 at 0.1, 0.4, 2 and 10 mg/kg. The treated mice were euthanized day 3 post treatment. The mouse spleens were collected and weighed day 3 post treatment. Single splenocyte suspensions were prepared, and the prepared splenocytes were stained for $CD4^+$ T cells, $CD8^+$ T cells and NK cells (with fluorochrome-conjugated anti-CD4, -CD8, and -NK1.1 antibodies), and analyzed by flow cytometry. The results showed that 2t2 was effective at expanding splenocytes based on spleen weight (FIG. 152A) especially at 0.1-10 mg/kg. The percentage of $CD8^+$ T cells were higher compared to control-treated mice (FIG. 152B) at 2 and 10 mg/kg. The percentage of NK cells were higher compared to control-treated mice (FIG. 152B) at all doses tested.

It has been known that IL-2 upregulates CD25 expression by immunocytes. We therefore accessed CD25 expression of $CD4^+$ T cells, $CD8^+$ T cells and NK cells in the 2t2 treated mice. C57BL/6 mice were subcutaneously treated with 2t2 as described in the paragraph above. The splenocytes were stained with fluorochrome-conjugated anti-CD4, -CD8, CD25 and NK1.1 monoclonal antibodies. The CD25 expression (MFI) of splenocyte subsets was analyzed by flow cytometry. As shown in FIG. 153, at the doses and time points tested, 2t2 significantly upregulated CD25 expression by $CD4^+$ T cells but not $CD8^+$ T cells or NK cells.

The pharmacokinetics of 2t2 in C57BL/6 mice were also investigated. 2t2 was subcutaneously injected into C57BL/6 mice at 1 mg/kg. The mouse blood was drawn from tail vein at various time points as shown in FIG. 154 and the serum was prepared. 2t2 concentrations were determined with ELISA (Capture: anti-tissue factor antibody; Detection: biotinylated anti-human IL-2 antibody followed by SA-HRP and ABTS substrate). The half-life of 2t2 was 1.83 hours calculated with PK Solutions 2.0 (Summit Research Services).

2t2 Attenuated the Formation of High Fat-Induced Atherosclerotic Plaques in ApoE$^{-/-}$ Mice Six-week-old female ApoE$^{-/-}$ mice (The Jackson Laboratory) were fed with standard chow diet or high diet fat (21% fat, 0.15% cholesterol, 34.1% sucrose, 19.5% casein, and 15% starch) (TD88137, Harlan Laboratories) and maintained in the standard conditions. At week 7, mice fed with high fat diet (HFD) were randomly assigned into control group and treatment group. Mice were then administrated either 2t2 (treatment group) or PBS (chow diet group and control group) subcutaneously at a dosage of 3 mg/kg weekly for 4 weeks. At week 12, all mice were euthanized by isoflurane. Aortas were collected, opened longitudinally and stained with Sudan IV solution (0.5%) using en face method. The percentage of plaque area (as shown in FIG. 155A) relative to total aorta area was then quantified with Image J software. FIG. 155A shows a representative view of atherosclerotic plaques from each group. FIG. 155B shows the results of quantitative analysis of atherosclerotic plaques of each group. The percentage of plaque areas in control group (HF Diet) was much higher than the treatment group (HFD+2t2), being 10.28% vs 4.68%.

2t2 Suppresses the Progression of Type 2 Diabetes.

Male BKS.Cg-Dock7$^m$+/+Lepr$^{db}$/J (db/db (Jackson Lab)) mice were fed with standard chow diet and received drinking water ad libitum. At the age of six weeks, mice were randomly assigned into control group and treatment group. The treatment group received 2t2 by subcutaneous injection at 3 mg/kg bi-weekly, while control group received vehicle (PBS) only. Overnight fasting glucose levels were measure weekly using a OneTouch Glucometer. The results showed that 2t2 effectively suppressed the increase of glucose levels in BKS.Cg-Dock7$^m$+/+Lepr$^{db}$/J mice (FIG. 156).

2t2 Significantly Upregulates the Ratio of $CD4^+CD25^+$ FoxP3$^+$ T Regulatory Cells in Blood Lymphocytes after the First Injection Male BKS.Cg-Dock7$^m$+/+Lepr$^{db}$/J (db/db) (The Jackson Laboratory) mice were fed with standard chow diet and received drinking water ad libitum. At the age of six weeks, mice were randomly assigned into control group and treatment group. The treatment group received 2t2 by subcutaneous injection at 3 mg/kg bi-weekly, while the control group received vehicle (PBS) only. Four days after the first drug injection, overnight fasting blood samples were collected and incubated with ACK lysing buffer (Thermo Fisher Scientific) at 37° C. for 5 minutes. Samples were then resuspended in FACS buffer (1×PBS (Hyclone) with 0.5% BSA (EMD Millipore) and 0.001% sodium azide (Sigma)) and surface stained with FITC-anti-CD4 and APC-anti-CD25 antibodies (BioLegend) for 30 minutes. Surface-stained samples were further fixed and premetallized with Fix/Perm buffer (BioLegend) and intracellular stained with PE-anti-Foxp3 antibody (BioLegend). After staining, cells were washed twice with FACs buffer and were analyzed by flow cytometry (Celesta-BD Bioscience). The percentage of $CD4^+CD25^+FoxP3^+$ Tregs in blood lymphocytes were measured. As shown in FIG. 157, the results showed that 2t2 significantly upregulated the ratio of Tregs in blood lymphocytes (*p<0.05).

Example 62. Production and Characterization of the Exemplary Single-Chain Chimeric Polypeptide 15t15

A second exemplary single-chain chimeric polypeptide including a first target-binding domain that binds to an IL-15 receptor, a soluble human tissue factor domain, and a second target-binding domain that binds to an IL-15 receptor was generated (IL-15/TF/IL-15; referred to at 15t15) (FIG. 158). The nucleic acid and amino acid sequences of this single-chain chimeric polypeptide are shown below.

Nucleic Acid Encoding Exemplary Single-Chain Chimeric Polypeptide (IL-15/TF/IL-15) (SEQ ID NO: 170)

```
(Signal peptide)
ATGAAGTGGGTGACCTTCATCAGCCTGCTGTTCCTGTTCTCCAGCGCCT
ACTCC (First IL-15 fragment)
AACTGGGTGAACGTGATCAGCGATTTAAAGAAGATCGAGGATTTAATCC
AGAGCATGCACATCGACGCCACTCTGTACACTGAGAGCGACGTGCACCC
TAGCTGCAAGGTGACTGCCATGAAGTGCTTTTTACTGGAGCTGCAAGTT
ATCTCTTTAGAGAGCGGCGATGCCAGCATCCACGACACTGTGGAGAATT
TAATCATTTTAGCCAACAACTCTTTAAGCAGCAACGGCAACGTGACAGA
GAGCGGCTGCAAGGAGTGCGAGGAGCTGGAGGAGAAGAACATCAAGGAG
TTTTTACAGAGCTTCGTGCACATCGTGCAGATGTTCATCAACACTAGC (Human tissue factor 219 form)
AGCGGCACAACCAACACAGTCGCTGCCTATAACCTCACTTGGAAGAGCA
CCAACTTCAAAACCATCCTCGAATGGGAACCCAAACCCGTTAACCAAGT
TTACACCGTGCAGATCAGCACCAAGTCCGGCGACTGGAAGTCCAAATGT
TTCTATACCACCGACACCGAGTGCGATCTCACCGATGAGATCGTGAAAG
ATGTGAAACAGACCTACCTCGCCCGGGTGTTTAGCTACCCCGCCGGCAA
TGTGGAGAGCACTGGTTCCGCTGGCGAGCCTTTATACGAGAACAGCCCC
GAATTTACCCCTTACCTCGAGACCAATTTAGGACAGCCCACCATCCAAA
GCTTTGAGCAAGTTGGCACAAAGGTGAATGTGACAGTGGAGGACGAGCG
GACTTTAGTGCGGCGGAACAACACCTTTCTCAGCCTCCGGGATGTGTTC
GGCAAAGATTTAATCTACACACTGTATTACTGGAAGTCCTCTTCCTCCG
GCAAGAAGACAGCTAAAACCAACACAAACGAGTTTTTAATCGACGTGGA
TAAAGGCGAAAACTACTGTTTCAGCGTGCAAGCTGTGATCCCCTCCCGG
ACCGTGAATAGGAAAAGCACCGATAGCCCCGTTGAGTGCATGGGCCAAG
AAAAGGGCGAGTTCCGGGAG (Second IL-15 fragment)
AACTGGGTGAACGTCATCAGCGATTTAAAGAAGATCGAAGATTTAATTC
AGTCCATGCATATCGACGCCACTTTATACACAGAATCCGACGTGCACCC
CTCTTGTAAGGTGACCGCCATGAAATGTTTTTTACTGGAGCTGCAAGTT
ATCTCTTTAGAGAGCGGAGACGCTAGCATCCACGACACCGTGGAGAATT
TAATCATTTTAGCCAATAACTCTTTATCCAGCAACGGCAACGTGACAGA
GTCCGGCTGCAAGGAGTGCGAAGAGCTGGAGGAGAAGAACATCAAGGAG
TTTCTGCAATCCTTTGTGCACATTGTCCAGATGTTCATCAATACCTCC
```

Exemplary Single-Chain Chimeric Polypeptide (IL-15/TF/IL-15) (SEQ ID NO: 169)

```
(Signal peptide)
MKWVTFISLLFLFSSAYS (Human IL-15)
NWVNVISDLKKIEDLIQSMHIDATLYTESDVHPSCKVTAMKCFLLELQV
ISLESGDASIHDTVENLIILANNSLSSNGNVTESGCKECEELEEKNIKE
FLQSFVHIVQMFINTS (Human Tissue Factor 219)
SGTTNTVAAYNLTWKSTNFKTILEWEPKPVNQVYTVQISTKSGDWKSKC
FYTTDTECDLTDEIVKDVKQTYLARVFSYPAGNVESTGSAGEPLYENSP
EFTPYLETNLGQPTIQSFEQVGTKVNVTVEDERTLVRRNNTFLSLRDVF
GKDLIYTLYYWKSSSSGKKTAKTNTNEFLIDVDKGENYCFSVQAVIPSR
TVNRKSTDSPVECMGQEKGEFRE (Human IL-15)
NWVNVISDLKKIEDLIQSMHIDATLYTESDVHPSCKVTAMKCFLLELQV
ISLESGDASIHDTVENLIILANNSLSSNGNVTESGCKECEELEEKNIKE
FLQSFVHIVQMFINTS
```

The nucleic acid encoding IL-15/TF/IL-15 was cloned into a modified retrovirus expression vector as described previously (Hughes et al., *Hum Gene Ther* 16:457-72, 2005). The expression vector encoding IL-15/TF/IL-15 was transfected into CHO-K1 cells. Expression of the expression vector in CHO-K1 cells allowed for secretion of the soluble IL-15/TF/IL-15 single-chain chimeric polypeptide (referred to as 15t15), which can be purified by anti-TF antibody affinity and other chromatography methods.

15t15 Promotes IL-2Rβ and Common γ Chain Containing 32Dβ Cell Proliferation

IL-15 activity of 15t15 was compared with recombinant IL-15 in IL2R13 and common γ chain expressed 32Dβ cells. IL-15 dependent 3214 cells were washed five times with IMDM-10% FBS and seeded to the wells at $2\times10^4$ cells/well. Serial dilutions of 15t15 or IL-15 were added to the cells (FIG. 159). Cells were incubated in a $CO_2$ incubator at 37° C. for 3 days. Cell proliferation was detected by adding 10 μl of WST1 to each well in the day 3 and incubating for an additional 3 hours in a $CO_2$ incubator at 37° C. The amount of formazan dye produced was analyzed by measuring the absorbance at 450 nm. As shown in FIG. 159, 15t15 promoted 32Dβ cell proliferation less efficiently as compared to IL-15. The $EC_{50}$ of 15t15 and IL-15 was 161.4 pM and 1.6 pM. respectively.

Purification Elution Chromatograph of 15t15 from Anti-TF Antibody Affinity Column 15t15 harvested from cell culture was loaded onto the anti-TF antibody affinity column equilibrated with 5 column volumes of PBS. After sample loading, the column was washed with 5 column volumes of PBS, followed by elution with 6 column volumes of 0.1M acetic acid, pH 2.9. A280 elution peak was collected and then neutralized to pH 7.5-8.0 with 1M Tris base. The neutralized sample was then buffer exchanged into PBS using Amicon centrifugal filters with a 30 kDa molecular weight cutoff. As shown in FIG. 160, the anti-TF antibody affinity column bound to 15t15 which contains TF as a fusion domain. The buffer-exchanged protein sample was stored at 2-8° C. for further biochemical analyses and biological activity tests. After each elution, the anti-TF antibody affinity column was stripped using 6 column volumes of 0.1M glycine, pH 2.5. The column was then neutralized using 5 column volumes of PBS, and 7 column volumes of 20% ethanol for storage. The anti-TF antibody affinity column was connected to a GE Healthcare AKTA Avant system. The flow rate was 4 mL/min for all steps except for the elution step, which was 2 mL/min.

Reduced SDS-PAGE of 15t15

To determine the purity and molecular weight of the protein, 15t15 protein sample purified with anti-TF antibody affinity column was analyzed by sodium dodecyl sulfate polyacrylamide gel (4-12% NuPage Bis-Tris gel) electrophoresis (SDS-PAGE) method under reduced condition. After electrophoresis, the gel was stained with InstantBlue for about 30 min, followed by destaining overnight in purified water.

To verify that the 15t15 protein undergoes glycosylation after translation in CHO cells, a deglycosylation experiment was conducted using the Protein Deglycosylation Mix II kit from New England Biolabs and the manufacturer's instructions. FIGS. 161A and 161B show the reduced SDS-PAGE analysis of the sample in non-deglycosylated (lane 1) and deglycosylated (lane 2) state. The results showed that the 15t15 protein is glycosylated when expressed in CHO cells. After deglycosylation, the purified sample ran with expected molecular weights (50 kDa) in reduced SDS gel. Lane M was loaded with 10 μL of SeeBlue Plus2 Prestained Standard.

Example 63: Stimulation of NK Cells In Vitro

A set of experiments was performed to assess the changes in surface phenotype of NK cells after stimulation with 18t15-12s, 18t15-12s16, and 7t15-21s+anti-TF antibody. In these experiments, fresh human leukocytes were obtained from the blood bank and CD56$^+$ NK cells were isolated with the RosetteSep/human NK cell reagent (StemCell Technologies). The purity of NK cells was >90% and confirmed by staining with CD56-BV421, CD16-BV510, CD25-PE, and CD69-APCFire750 antibodies (BioLegend). The cells were counted and resuspended at $0.2 \times 10^6$/mL in a 96-well flat-bottom plate in 0.2 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)). The cells were stimulated with: 18t15-12s (100 nM); 18t15-12s16 (100 nM); a mixture of single cytokines rhIL-15 (50 ng/mL) (Miltenyi), rhIL18 (50 ng/mL) (Invivogen), and rhIL-12 (10 ng/mL) (Peprotech); 7t15-21s+anti-TF antibody (100 nM-50 nM); 7t15-21s (100 nM); or anti-TF antibody (50 nM) at 37° C. and 5% $CO_2$ for 16 hours. The next day, the cells were harvested and surface stained for 30 minutes with CD56, CD16, CD25, CD69, CD27, CD62L, NKp30, and NKp44 specific antibodies. After surface staining, the cells were washed (1500 RPM for 5 minutes at room temperature) in FACS buffer (1×PBS (Hyclone) with 0.5% BSA (EMD Millipore) and 0.001% sodium azide (Sigma)). After two washes, the cells were analyzed by flow cytometry (Celesta-BD Bioscience). FIGS. 162A and 162B shows that overnight incubation of purified NK cells with 18t15-12s, 18t15-12s16, and 7t15-21s+anti-TF antibody resulted in an increase in the percentage of cells expressing CD25, CD69, NKp44, and NKp30 activation markers and a decrease in the percentage of cells expressing CD62L. All activation marker data is from CD56$^+$ gated lymphocytes.

A set of experiments was performed to assess changes in the surface phenotype of lymphocyte populations after stimulation with 18t15-12s, 18t15-12s16, and 7t15-21s. In these experiments, fresh human leukocytes were obtained from the blood bank. Peripheral blood lymphocytes were isolated with the Ficoll-PAQUE Plus (GE Healthcare) density gradient media. The cells were counted and resuspended at $0.2 \times 10^6$/mL in a 96-well flat-bottom plate in 0.2 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)). The cells were stimulated with: 18t15-12s (100 nM); 18t15-12s16 (100 nM), a mixture of single cytokines rhIL-15 (50 ng/mL) (Miltenyi), rhIL18 (50 ng/mL) (Invivogen), and rhIL-12 (10 ng/mL) (Peprotech); 7t15-21s (100 nM)+anti-TF antibody (50 nM); 7t15-21s (100 nM); or anti-TF antibody (50 nM) at 37° C. and 5% $CO_2$ for 16 hours. The next day, the cells were harvested and surface stained for 30 minutes for CD4 or CD8, CD62L, and CD69 specific antibodies. After surface staining, cells were washed (1500 RPM for 5 minutes at room temperature) in FACS buffer (1×PBS (Hyclone) with 0.5% BSA (EMD Millipore) and 0.001% sodium azide (Sigma)). After two washes, the cells were analyzed by flow cytometry (Celesta-BD Bioscience). FIG. 163 shows that overnight incubation of purified lymphocyte populations (CD4 and CD8 T cells) with 18t15-12s, 18t15-12s16, or 7t15-21s+anti-TF antibody resulted in an increase in the percentage of CD8 and CD4 T cells expressing CD69. Additionally, incubation with 7t15-21s+anti-TF antibody resulted in an increase in the percentage of CD8 and CD4 T cells expressing CD62L (FIG. 163).

A set of experiments was performed to determine the effect of 18t15-12s on the extracellular acidification rate (ECAR) of NK cells purified from human blood. ECAR can be used to measure glycolysis. Glycolysis is the intracellular biochemical conversion of one molecule of glucose into two molecules of pyruvate with the concurrent generation of two molecules of ATP. An increase in glycolysis was indicated by an increase in ECAR measured by a Seahorse XF96 Analyzer. In these experiments, fresh human leukocytes were obtained from the blood bank and CD56$^+$ NK cells were isolated with the RosetteSep/human NK cell reagent (StemCell Technologies). The purity of NK cells was >70% and confirmed by staining for CD56-BV421, CD16-BV510, CD25-PE, and CD69-APCFire750 antibodies (BioLegend). The cells were counted and resuspended in $0.2 \times 10^6$/mL in a 96-well flat-bottom plate in 0.2 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)). The cells were stimulated with either a mixture of single cytokines hIL-12 (10 ng/mL) (Biolegend), hIL-18 (50 ng/mL) (R&D), and hIL-15 (50 ng/mL) (NCI) or 18t15-12s (100 nM) at 37° C. and 5% $CO_2$ for 14-18 hours. The next day, the cells were harvested and washed two times in Seahorse media. The cells ($2 \times 10^5$ cells/well) were seeded in 96-well flux plates that were coated with 10 μL of poly-L-lysine (Sigma). NK cells were adhered to plates for 30 minutes prior to the assay. Glucose, oligomycin, and 2DG solutions were prepared at 10× concentration in buffered Seahorse medium and injected in port A, B, and C of the calibration plate. ECAR readings were taken every 6.5-7 minutes and ECAR results represent the average readings over 80 minutes or average readings at each timepoint. FIG. 164 shows overnight stimulation of NK cells with 18t15-12s resulted in increased basal ECAR levels. The addition of glucose and oligomycin further showed enhanced glycolysis and glycolytic capacity, respectively, of NK cells stimulated with 18t15-12s overnight (FIG. 164). NK cells treated overnight with media alone or a mixture of IL12, IL18, and IL-15 were used for comparison (FIG. 164).

A set of experiments was performed to determine the increase in phospho-STAT4 and phospho-STAT5 levels in NK cells after stimulation with 18t15-12s. In these experiments, fresh human leukocytes were obtained from the blood bank and CD56+NK cells were isolated with the RosetteSep/human NK cell reagent (StemCell Technologies). The purity of NK cells was >70% and confirmed by staining with CD56-BV421, CD16-BV510, CD25-PE, and CD69-APCFire750 specific antibodies (BioLegend). The cells were counted and resuspended in $0.05 \times 10^6$/mL in a 96-well flat-bottom plate in 0.1 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)). The cells were stimulated with hIL-12 (10 ng/mL) (Biolegend) or hIL-15 (50 ng/mL) (NCI) (Single cytokines), or 18t15-12s (100 nM) at 37° C. and 5% $CO_2$ for 90 minutes. Unstimulated NK cells (US) were used as a control. The cells were harvested and fixed in paraformaldehyde (Sigma) to a final concentration of 1.6%. Plates were incubated in the dark at room temperature for 10 minutes. FACS buffer (1×PBS (Hyclone) with 0.5% BSA (EMD Millipore) and 0.001% sodium azide (Sigma)) (100 µL) was added and cells were transferred to 96-well "V" bottom plate. The cells were washed for 1500 RPM for 5 minutes at room temperature. The cell pellet was mixed with 100 µL chilled methanol by gently pipetting up and down, and cells were incubated for 30 minutes at 4° C. The cells were mixed with 100 mL of FACS buffer and washed for 1500 RPM for 5 minutes at room temperature. The cell pellets were mixed with 50 mL of FACS buffer containing 4 mL of pSTAT4 (BD Bioscience) and pSTAT5 antibodies (BD Bioscience) followed by incubation for 30 minutes at room temperature in the dark. The cells were mixed with 100 mL of FACS buffer and washed for 1500 RPM for 5 minutes at room temperature. The cell pellets were mixed with 50 mL of FACS buffer and cells were analyzed by flow cytometry (Celesta-BD Bioscience). FIG. 165 shows that incubation of NK cells with 18t15-12s induced an increase in pSTAT4 and pSTAT5 (plotted data, normalized fold-change).

A set of experiments was performed to determine the effect of 18t15-12s or a mixture of cytokines (e.g., IL12, IL18, and IL-15) on oxygen consumption rate (OCR) and extracellular acidification rate (ECAR) on NK cells purified from human blood. OCR and ECAR were measured by a Seahorse XF96 Analyzer. In these experiments, fresh human NK cells were isolated from human leukocytes via negative selection using the RosetteSep/human NK cell reagent (StemCell Technologies). Freshly purified NK cells were stimulated overnight (16 h) with either 18t15-12s (100 nM) or a mixture of rhIL12 (10 ng/mL), rhIL18 (50 ng/mL), and rhIL-15 (50 ng/mL) cytokines as a control. The next day, the cells were washed, counted, and equal numbers of cells were plated in buffered Seahorse media. Glucose, oligomycin, and 2DG solutions were prepared at 10× concentration in buffered Seahorse medium and injected in port A, B, and C of the calibration plate. FIG. 166 shows OCR (left) and ECAR (right) data from two individual donors. Overnight stimulation of NK cells with 18t15-12s resulted in an increase in basal ECAR and OCR levels. Addition of glucose and oligomycin further showed enhanced glycolysis and glycolytic capacity, respectively, of NK cells stimulated with 18t15-12s overnight. NK cells treated overnight with media alone or a mixture of IL12, IL18, and IL-15 were used for comparison.

Example 64: Stimulation of NK Cells In Vivo by 2t2 and/or TGFRt15-TGFRs

A set of experiments was performed to determine the effect of the 2t2 construct on immune stimulation in C57BL/6 mice. In these experiments, C57BL/6 mice were subcutaneously treated with control solution (PBS) or 2t2 at 0.1, 0.4, 2, and 10 mg/kg. Treated mice were euthanized 3 days post-treatment. Spleen weight was measured and single splenocyte suspensions were prepared. Splenocytes suspensions were stained with conjugated anti-CD4, anti-CD8, and anti-NK1.1 (NK) antibodies. The percentage of $CD4^+$ T cells, $CD8^+$ T cells, and NK cells, and CD25 expression on lymphocyte subsets were analyzed by flow cytometry. FIG. 167A shows that 2t2 was effective at expanding splenocytes based on spleen weight especially at a dose level of 0.1-10 mg/kg. Following treatment, the percentage of $CD8^+$ T cells were higher in 2t2-treated mice compared to control-treated mice at 2 and 10 mg/kg (FIG. 167B). The percentage of NK cells were also higher in 2t2-treated mice compared to control-treated mice at all doses of 2t2 tested (FIG. 167B). Additionally, 2t2 significantly upregulated CD25 expression by $CD4^+$ T cells, but not $CD8^+$ T cells and NK cells following treatment at 0.4 to 10 mg/kg (FIG. 167C).

A set of experiments was performed to determine the effect of the TGFRt15-TGFRs construct on immune stimulation in C57BL/6 mice. In these experiments, C57BL/6 mice were subcutaneously treated with control solution (PBS) or TGFRt15-TGFRs at 0.3, 1, 3, and 10 mg/kg. The treated mice were euthanized 4 days post-treatment. Spleen weight was measured and single splenocyte suspensions were prepared. The splenocytes suspensions were stained with conjugated anti-CD4, anti-CD8, and anti-NK1.1 (NK) antibodies. The percentage of $CD4^+$ T cells, $CD8^+$ T cells, and NK cells were analyzed by flow cytometry. FIG. 168A shows that spleen weight in mice treated with TGFRt15-TGFRs increased with increasing dosage of TGFRt15-TGFRs. Additionally, spleen weight in mice treated with 1 mg/kg, 3 mg/kg, and 10 mg/kg of TGFRt15-TGFRs were higher as compared to mice treated with the control solution. FIG. 168B shows that the percentages of $CD8^+$ T cells and NK cells both increased with increasing dosage of TGFRt15-TGFRs. Specifically, the percentages of $CD8^+$ T cells were higher in mice treated with 0.3 mg/kg, 3 mg/kg, and 10 mg/kg of TGFRt15-TGFRs compared to control-treated mice, and the percentages of NK cells were higher in mice treated with 0.3 mg/kg, 1 mg/kg, 3 mg/kg, and 10 mg/kg of TGFRt15-TGFRs compared to control-treated mice.

A set of experiments was performed to determine the effect of the TGFRt15-TGFRs construct or 2t2 construct on immune stimulation in ApoE$^{-/-}$ mice fed with a Western diet. In these experiments, 6-week old female B6.129P2-ApoE$^{tm1Unc}$/J mice (Jackson Laboratory) were fed with a Western diet containing 21% fat, 0.15% cholesterol, 34.1% sucrose, 19.5% casein, and 15% starch (TD88137, Envigo Laboratories). After 8-weeks of the Western diet, the mice were injected subcutaneously with TGFRt15-TGFRs or 2t2 at 3 mg/kg. Three days post treatment, mice were fasted for 16 hours and then blood samples were collected through retro-orbital venous plexus puncture. The blood was mixed with 10 µL 0.5 M EDTA, and 20 µL blood was taken for lymphocyte subsets analysis. The red blood cells were lysed with ACK (0.15 M $NH_4Cl$, 1.0 mM $KHCO_3$, 0.1 mM $Na_2EDTA$, pH 7.4) and the lymphocytes were stained with anti-mouse CD8a and anti-mouse NK1.1 antibodies for 30 minutes at 4° C. in FACS staining buffer (1% BSA in PBS). The cells were washed once and analyzed with a BD FACS Celesta. For Treg staining, ACK treated blood lymphocytes were stained with anti-mouse CD4 and anti-mouse CD25 antibodies for 30 minutes at 4° C. in FACS staining buffer. The cells were washed once and resuspended in fixation/ permeabilization working solution and incubated at room temperature for 60 minutes. The cells were washed once and resuspended in permeabilization buffer. The samples were centrifuged at 300-400×g for 5 minutes at room temperature and the supernatant was then discarded. The cell pellet was resuspended in residual volume and the volume adjusted to about 100 µL with 1× permeabilization buffer. Anti-Foxp3 antibody was added to the cells, and the cells were incubated for 30 minutes at room temperature. Permeabilization buffer (200 µL) was added to the cells, and the cells were centrifuged at 300-400×g for 5 minutes at room temperature. The cells were resuspended in flow cytometry staining buffer and analyzed on a flow cytometer. FIGS. 169B-169C show that treatment with TGFRt15-TGFRs and 2t2 increased the percentage of NK cells and CD8$^+$ T cells in ApoE$^{-/-}$ mice fed with Western diet. FIG. 169A shows that treatment with 2t2 also increased the percentage of Treg cells.

Example 65: Induction of Proliferation of Immune Cells In Vivo

A set of experiments was performed to determine the effect of the 2t2 construct on immune cell stimulation in C57BL/6 mice. In these experiments, C57BL/6 mice were subcutaneously treated with control solution (PBS) or 2t2 at 0.1, 0.4, 2, and 10 mg/kg. Treated mice were euthanized 3 days post-treatment. Spleen weight was measured and single splenocyte suspensions were prepared. The splenocyte suspensions were stained with conjugated anti-CD4, anti-CD8, and anti-NK1.1 (NK) antibodies. The percentage of CD4$^+$ T cells, CD8$^+$ T cells, and NK cells were analyzed by flow cytometry. FIG. 170A shows that 2t2 treatment was effective at expanding splenocytes based on spleen weight especially at 0.1-10 mg/kg. The percentage of CD8$^+$ T cells was higher compared to control-treated mice at 2 and 10 mg/kg (FIG. 170B). Additionally, the percentage of NK cells was higher compared to control-treated mice at all doses of 2t2 tested (FIG. 170B). These results demonstrate that 2t2 treatment was able to induce proliferation of CD8$^+$ T cells and NK cells in C57BL/6 mice.

A set of experiments was performed to determine the effect of the TGFRt15-TGFRs construct on immune stimulation in C57BL/6 mice. In these experiments, C57BL/6 mice were subcutaneously treated with control solution (PBS) or TGFRt15-TGFRs at 0.1, 0.3, 1, 3, and 10 mg/kg. The treated mice were euthanized 4 days post-treatment. Spleen weight was measured and splenocyte suspensions were prepared. The splenocyte suspensions were stained with conjugated anti-CD4, anti-CD8, and anti-NK1.1 (NK) antibodies. The cells were additionally stained for proliferation marker Ki67. FIG. 171A shows that spleen weight in mice treated with TGFRt15-TGFRs increased with increasing dosage of TGFRt15-TGFRs. Additionally, spleen weight in mice treated with 1 mg/kg, 3 mg/kg, and 10 mg/kg of TGFRt15-TGFRs was higher as compared to mice treated with just the control solution. The percentages of CD8$^+$ T cells and NK cells both increased with increasing dosage of TGFRt15-TGFRs (FIG. 171B). Finally, TGFRt15-TGFRs significantly upregulated expression of cell proliferation marker Ki67 in both CD8$^+$ T cells and NK cells at all doses of TGFRt15-TGFRs tested. These results demonstrate that TGFRt15-TGFRs treatment induced proliferation of both CD8$^+$ T cells and NK cells in C57BL/6 mice.

A set of experiments was performed to determine the effect of the TGFRt15-TGFRs construct or the 2t2 construct on immune stimulation in ApoE$^{-/-}$ mice fed with a Western diet. In these experiments, 6-week old female B6.129P2-ApoE$^{tm1Unc}$/J mice (Jackson Laboratory) were fed with a Western diet containing 21% fat, 0.15% cholesterol, 34.1% sucrose, 19.5% casein, and 15% starch (TD88137, Envigo Laboratories). After 8-week of the Western diet, the mice were injected subcutaneously with TGFRt15-TGFRs or 2t2 at 3 mg/kg. Three days post-treatment, the mice were fasted for 16 hours and then blood samples were collected through retro-orbital venous plexus puncture. The blood was mixed with 10 µL 0.5 M EDTA and 20 µL blood was taken for lymphocyte subsets analysis. The red blood cells were lysed with ACK (0.15 M NH$_4$Cl, 1.0 mM KHCO$_3$, 0.1 mM Na$_2$EDTA, pH 7.4) and the lymphocytes were stained with anti-mouse CD8a and anti-mouse NK1.1 antibodies for 30 minutes at 4° C. in FACS staining buffer (1% BSA in PBS). The cells were washed once and resuspended in Fixation Buffer (BioLegend Cat #420801) for 20 minutes at room temperature. The cells were centrifuged at 350×g for 5 minutes, the fixed cells were resuspended in Intracellular Staining Permeabilization Wash Buffer (BioLegend Cat #421002) and then centrifuged at 350×g for 5 minutes. The cells were then stained with anti-Ki67 antibody for 20 minutes at RT. The cells were washed twice with Intracellular Staining Permeabilization Wash Buffer and centrifuged at 350×g for 5 minutes. The cells were then resuspended in FACS staining buffer. Lymphocyte subsets were analyzed with a BD FACS Celesta. As described in FIG. 172A, treatment of ApoE$^{-/-}$ mice with TGFRt15-TGFRs induced proliferation (Ki67-positive staining) in NK and CD8$^+$ T cells. Additionally, FIG. 172B shows treatment of ApoE$^{-/-}$ mice with 2t2 also induced proliferation (Ki67-positive staining) in NK and CD8$^+$ T cells.

A set of experiments was performed to determine the effect 7t15-21s+anti-TF antibody-expanded NK cells in NSG mice following treatment with 7t15-21s, TGFRt15-TGFRs, and 2t2. In these experiments, fresh human leukocytes were obtained from the blood bank and CD56$^+$ NK cells were isolated with the RosetteSep/human NK cell reagent (StemCell Technologies). The purity of NK cells was >90% and confirmed by staining with CD56-BV421, CD16-BV510, CD25-PE, and CD69-APCFire750 antibodies (BioLegend). The cells were counted and resuspended in 2×10$^6$/mL in a 24-well flat-bottom plate in 2 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)). The cells were stimulated with: 7t15-21s (100 nM) and anti-TF antibody (50 nM) for 15 days. After every 2 days, the cells were resuspended at 2×10$^6$/mL with fresh media containing 100 nM 7t15-21s and 50 nM of anti-TF antibody. As the volume of the cultures increased, the cells were transferred to higher volume flasks. The cells were counted using trypan blue to access the fold-expansion. 7t15-21s+anti-TF antibody-expanded NK cells were washed three times in warm HBSS Buffer (Hyclone) at 1000 RPM for 10 minutes at room temperature. The 7t15-21s+anti-TF antibody-expanded-NK cells were resuspended in 10×10$^6$/0.2 mL HBSS buffer and injected intravenously into the tail vein of NSG mice (NOD scid common gamma mouse) (Jackson Laboratories). The transferred NK cells were supported every 48 hours with either 7t15-21s (10 ng/dose, i.p.), TGFRt15-TGFRs (10 ng/dose, i.p.) or 2t2 (10 ng/dose, i.p.) for up to 21 days. Engraftment and persistence of the human 7t15-21s+anti-TF antibody-expanded NK cells were measured every week in blood staining for hCD45, mCD45, hCD56, hCD3, and hCD16 antibodies by flow cytometry (Celesta-BD Bioscience) (Data represent 3 mice per group). FIG. 173 indicates that treatment of mice bearing adoptively-transferred 7t15-21s+anti-TF antibody-expanded NK cells with 7t15-21s-, TGFRt15-TGFRs-, or 2t2-induced expansion and persistence of the adoptively transferred NK cells compared to control treated mice.

Example 66: NK-Mediated Cytotoxicity Following Treatment with Single-Chain Constructs or Multi-Chain Constructs A set of experiments was performed to determine if treatment of NK cells with TGFRt15-TGFRs enhanced cytotoxicity of NK cells. In these experiments, Human Daudi B lymphoma cells were labeled with CellTrace Violet (CTV) and used as tumor target cells. Mouse NK effector cells were isolated with NK1.1-positive selection using a magnetic cell sorting method (Miltenyi Biotec) of C57BL/6 female mouse spleens 4 days post TGFRt15-TGFRs subcutaneous treatment at 3 mg/kg. Human NK effector cells were isolated from peripheral blood mononuclear cells derived from human blood buffy coats with the RosetteSep/human NK cell reagent (Stemcell Technologies). The target cells (Human Daudi B lymphoma cells) were mixed with effector cells (either mouse NK effector cells or human NK effector cells) in the presence of 50 nM TGFRt15-TGFRs or in the absence of TGFRt15-TGFRs (control) and incubated at 37° C. for 44 hours for mouse NK cells and for 20 hours for human NK cells. Target cell (Daudi) viability was assessed by analysis of propidium iodide-positive, CTV-labeled cells using flow cytometry. The percentage of Daudi inhibition was calculated using the formula (1-viable tumor cell number in experimental sample/viable tumor cell number in the sample without NK cells)×100. FIG. 174 shows that mouse (FIG. 174A) and human (FIG. 174B) NK cells had significantly stronger cytotoxicity against Daudi B cells following NK cell activation with TGFRt15-TGFRs than in the absence of TGFRt15-TGFRs activation.

A set of experiments was performed to determine antibody-dependent cellular cytotoxicity (ADCC) of mouse and human NK cells following treatment with TGFRt15-TGFRs. In these experiments, human Daudi B lymphoma cells were labeled with CellTrace Violet (CTV) and used as tumor target cells. Mouse NK effector cells were isolated with NK1.1-positive selection using a magnetic cell sorting method (Miltenyi Biotec) of C57BL/6 female mouse spleens 4 days post-TGFRt15-TGFRs subcutaneous treatment at 3 mg/kg. Human NK effector cells were isolated from peripheral blood mononuclear cells derived from human blood buffy coats with the RosetteSep/human NK cell reagent (Stemcell Technologies). The target cells (Daudi B cells) were mixed with effector cells (either mouse NK effector cells or human NK effector cells) in the presence of anti-CD20 antibody (10 nM Rituximab, Genentech) and in the presence of 50 nM TGFRt15-TGFRs, or in the absence of TGFRt15-TGFRs (control) and incubated at 37° C. for 44 hours for mouse NK cells and for 20 hours for human NK cells. The Daudi B cells express the CD20 targets for the anti-CD20 antibody. Target cell viability was assessed after incubation by analysis of propidium iodide-positive, CTV-labeled target cells using flow cytometry. The percentage of Daudi inhibition was calculated using the formula (1–viable tumor cell number in experimental sample/viable tumor cell number in the sample without NK cells)×100. FIG. 175 shows that mouse NK cells (FIG. 175A) and human NK cells (FIG. 175B) had stronger ADCC activity against Daudi B cells following NK cell activation with TGFRt15-TGFRs than in the absence of TGFRt15-TGFRs activation.

A set of experiments was performed to determine cytotoxicity of TGFRt15-TGFRs-activated mouse NK cells towards senescent B16F10 melanoma cells. In these experiments, mouse NK cells were activated in vivo by injecting C57BL/6 mice with 10 mg/kg of TGFRt15-TGFRs for 4 days followed by isolation of splenic NK cells. The NK cells were then expanded in vitro for 7 days in the presence of 100 nM 2t2. The B16F10 senescent target cells (B16F10-SNC) were labelled with CellTrace Violet (CTV) and incubated at different Effector:Target (E:T) ratios with the activated mouse NK effector cells for 16 hours. The cells were trypsinized, washed, and resuspended in complete media containing propidium iodide (PI) solution. The cytotoxicity of the TGFRt15-TGFRs/2t2-activated NK cells against the senescent cell targets was accessed by flow cytometry based on PI staining of the CTV-labeled cells. The findings demonstrate that in vivo activation of NK cells with TGFRt15-TGFRs followed by in vitro expansion and activation with 2t2 resulted in increased killing of senescent melanoma tumor cells by the NK cells (FIG. 176).

Example 67: Treatment of Cancer, Diabetes, and Atherosclerosis

Figure 177A:
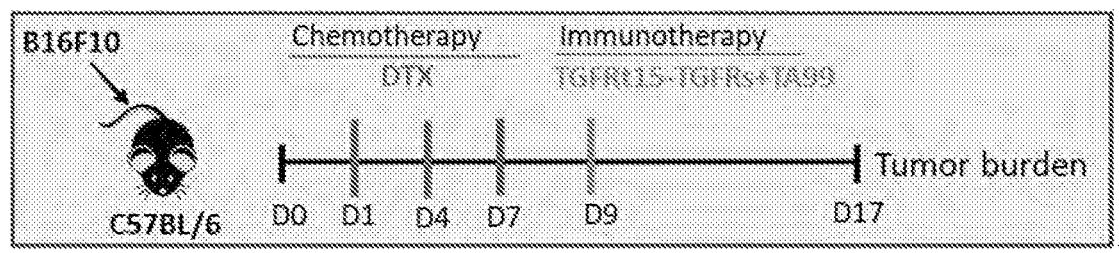
Figure 177B:
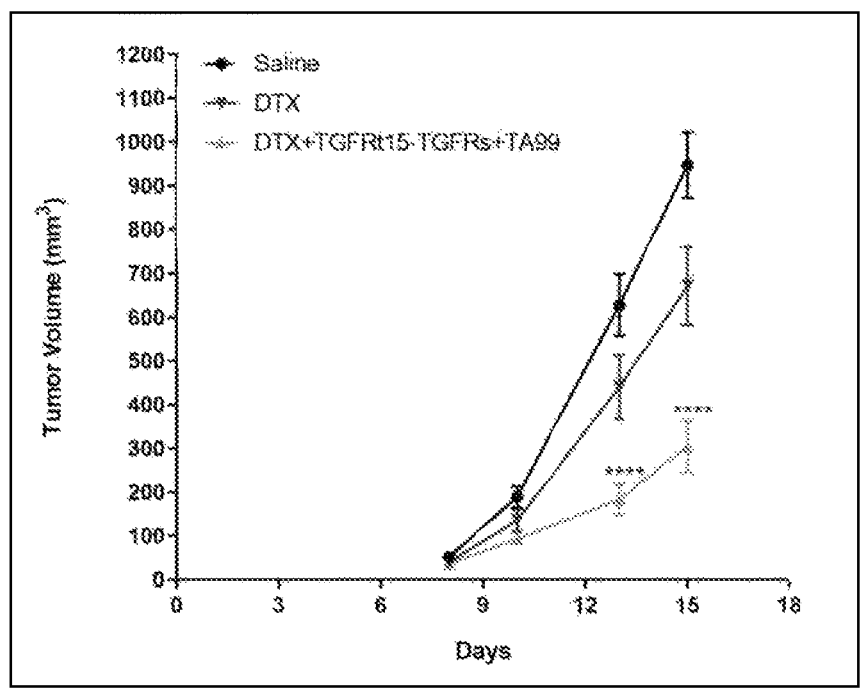

A set of experiments was performed to assess antitumor activity of TGFRt15-TGFRs plus anti-TRP1 antibody (TA99) in combination with chemotherapy in a melanoma mouse model. In these experiments, C57BL/6 mice were subcutaneously injected with $0.5 \times 10^6$ B16F10 melanoma cells. The mice were treated with three doses of chemotherapy docetaxel (10 mg/kg) (DTX) on day 1, day 4, and day 7, followed by treatment with single dose of combination immunotherapy TGFRt15-TGFRs (3 mg/kg)+anti-TRP1 antibody TA99 (200 µg) on day 9. FIG. 177A shows a schematic of the treatment regimen. Tumor growth was monitored by caliper measurement, and tumor volume was calculated using the formula $V=(L \times W^2)/2$, where L is the largest tumor diameter and W is the perpendicular tumor diameter. FIG. 177B shows that treatment with DTX+TGFRt15-TGFRs+TA99 significantly reduced tumor growth compared to saline control and DTX treatment groups (N=10, ****$p<0.001$, Multiple t test analyses).

Figure 177C:
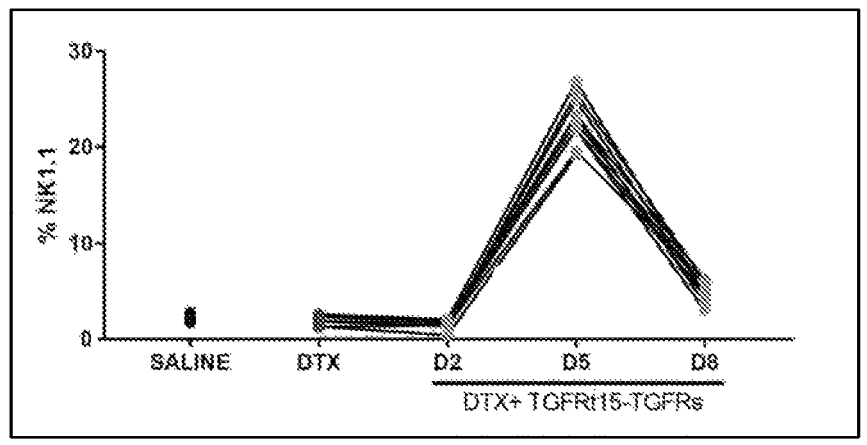
Figure 177D:
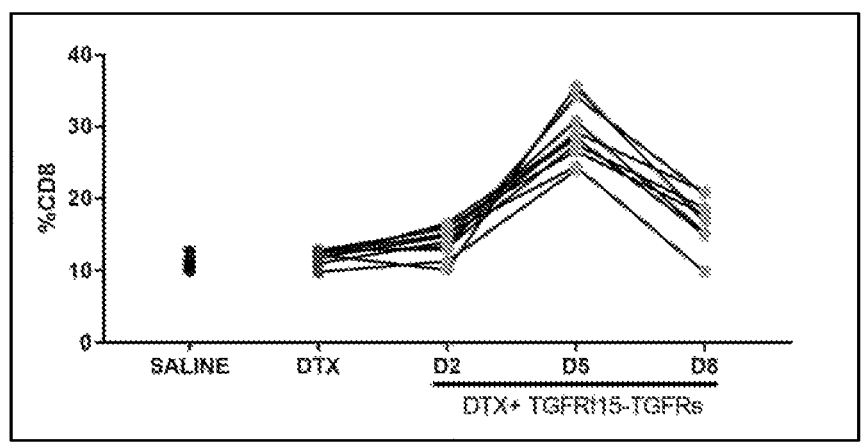
Figure 177E:
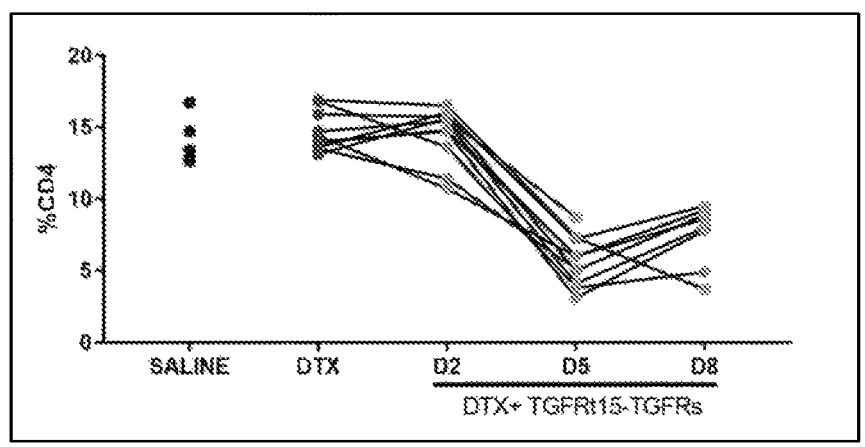

To assess immune cell subsets in the B16F10 tumor model, peripheral blood analysis was performed. In these experiments, C57BL/6 mice were injected with B16F10 cells and treated with DTX, DTX+TGFRt15-TGFRs+TA99, or saline. Blood was drawn from the submandibular vein of B16F10 tumor-bearing mice on days 2, 5, and 8 post-immunotherapy for the DTX+TGFRt15-TGFRs+TA99 group and day 11 post-tumor injection for the DTX and saline groups. RBCs were lysed in ACK lysis buffer and the lymphocytes were washed and stained with anti-NK1.1, anti-CD8, and anti-CD4 antibodies. The cells were analyzed by flow cytometry (Celesta-BD Bioscience). FIGS. 177C-177E show that DTX+TGFRt15-TGFRs+TA99 treatment induced an increase in the percentage of NK cells and $CD8^+$ T cells in the tumors compared to the saline and DTX treatment groups.

Figure 177F:
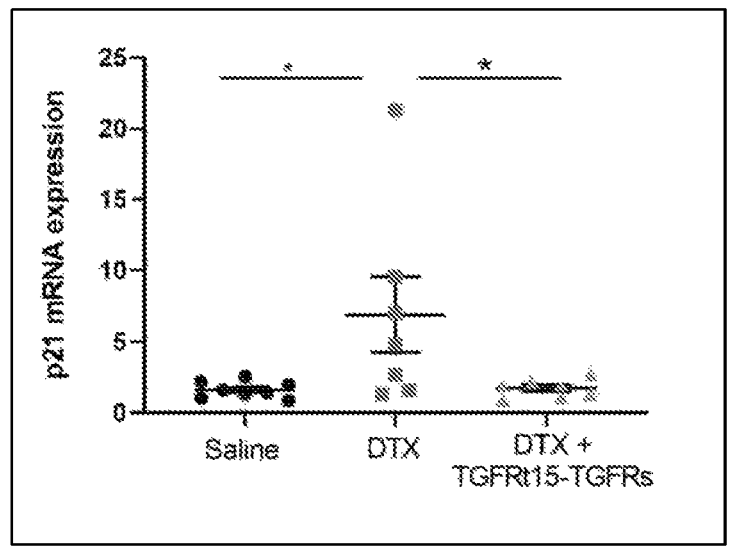
Figure 177G:
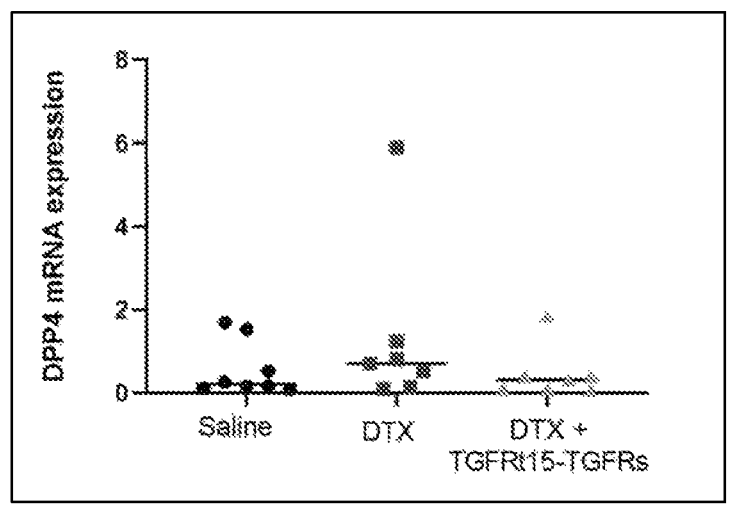
Figure 177H:
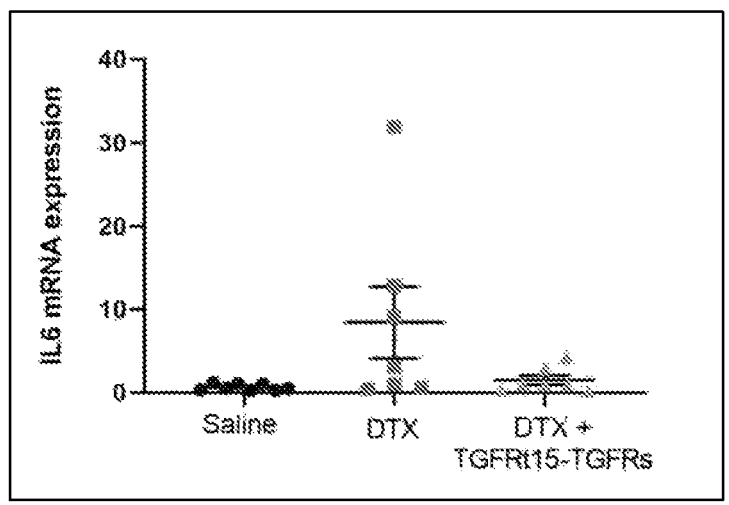

On day 17, total RNA was extracted from tumors of mice treated with saline, DTX or DTX+TGFRt15-TGFRs+TA99 using Trizol. Total RNA (1 µg) was used for cDNA synthesis using the QuantiTect Reverse Transcription Kit (Qiagen). Real-time PCR was carried out with CFX96 Detection System (Bio-Rad) using FAM-labeled predesigned primers for senescence cell markers, (F) p21 (G) DPP4 and (H) IL6. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct=Ct_{target}-Ct_{18S}$. The data is presented as fold-change as compared to saline control. FIG. 177F-177H show that DTX treatment induced an increase in senescent tumor cells that were subsequently reduced following treatment with TGFRt15-TGFRs+TA99 immunotherapy.

A set of experiments was performed to investigate amelioration of Western diet-induced hyperglycemia in ApoE$^{-/-}$ mice by 2t2. In these experiments, 6-week old female B6.129P2-ApoE$^{tm1Unc}$/J a mice (Jackson Laboratory) were fed with a Western diet containing 21% fat, 0.15% cholesterol, 34.1% sucrose, 19.5% casein, and 15% starch (TD88137, Envigo Laboratories). After 8-weeks of the Western diet, the mice were injected subcutaneously with TGFRt15-TGFRs or 2t2 at 3 mg/kg. Three days post-treatment, the mice were fasted for 16 hours and then blood samples were collected through retro-orbital venous plexus puncture. Blood glucose was detected with a glucose meter (OneTouch UltraMini) and GenUltimated test strips using a drop of fresh blood. As shown in FIG. 178A, 2t2 treatment significantly reduced hyperglycemia induced by the Western diet ($p<0.04$). The plasma insulin and resistin levels were analyzed with Mouse Rat Metabolic Array by Eve Technologies. HOMA-IR was calculated using the following formula: homeostatic model assessment-insulin resistance=Glucose (mg/dL)*Insulin (mU/mL)/405. As shown in FIG. 178B, both 2t2 and TGFRt15-TGFRs treatment reduced insulin resistance compared to the untreated group. Both 2t2 ($p<0.02$) and TGFRt15-TGFRs ($p<0.05$) reduced resistin levels significantly compared to the untreated group as shown in FIG. 178C, which may relate to the reduced insulin resistance induced by 2t2 and TGFRt15-TGFRs (FIG. F3B).

Example 68: Induction of Differentiation of NK Cells into Cytokine-Induced Memory Like NK Cells A set of experiments was performed to assess the differentiation of NK cells into cytokine-induced memory like NK Cells (CIMK-NK Cells) after stimulation with 18t15-12s. In these experiments, fresh human leukocytes were obtained from the blood bank and CD56$^+$ NK cells were isolated with the RosetteSep/human NK cell reagent (StemCell Technologies). The purity of NK cells was >90% and confirmed by staining with CD56-BV421, CD16-BV510, CD25-PE, and CD69-APCFire750 antibodies (BioLegend). The cells were counted and resuspended in 2×10$^6$/mL in a 24-well flat-bottom plate in 2 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)). The cells were unstimulated ("No Spike") or stimulated with 18t15-12s (100 nM) or a mixture of single cytokines including rhIL-15 (50 ng/mL) (Miltenyi), rhIL18 (50 ng/mL) (Invivogen), and rhIL-12 (10 ng/mL) (Peprotech) ("single cytokines") at 37° C. and 5% CO$_2$ for 16 hrs. The next day, the cells were harvested, and washed two times with warm complete media at 1000 RPM for 10 minutes at room temperature. The cells were resuspended at 2×10$^6$/mL in a 24-well flat-bottom plate in 2 mL of complete media with rhIL-15 (1 ng/mL). After every 2 days, half of the medium was replaced with fresh complete media containing rhIL-15.

To assess the change in memory phenotype of NK cells at day 7, the cells were stained with antibodies to cell-surface CD56, CD16, CD27, CD62L, NKp30, and NKp44 (BioLegend). After surface staining, the cells were washed (1500 RPM for 5 minutes at room temperature) in FACS buffer (1×PBS (Hyclone) with 0.5% BSA (EMD Millipore) and 0.001% sodium azide (Sigma)). After two washes, the cells were analyzed by flow cytometry (Celesta-BD Bioscience). FIG. 179 shows that incubation of NK cells with 18t15-12s resulted in an increase in the percentage of CD16$^+$CD56$^+$NK cells expressing CD27, CD62L, and NKp44, and an increase in the levels (MFI) of NKp30 in CD16$^+$CD56$^+$NK cells.

Example 69. Upregulation of CD44 Memory T Cells

C57BL/6 mice were subcutaneously treated with TGFRt15-TGFRs or 2t2. The treated mice were euthanized and the single splenocyte suspensions were prepared 4 days (TGFRt15-TGFRs) or 3 days (2t2) following the treatment. The prepared splenocytes were stained with fluorochrome-conjugated anti-CD4, anti-CD8 and anti-CD44 antibodies and the percentages of CD44 h Ig h T cells in CD4$^+$ T cells or CD8$^+$ T cells were analyzed by flow cytometry. The results show that TGFRt15-TGFRs and 2t2 upregulated expression of the memory marker CD44 on CD4$^+$ and CD8$^+$ T cells (FIG. 180). These findings indicate that TGFRt15-TGFRs and 2t2 molecules were able to induce mouse T cells to differentiate into memory T cells.

Example 70: Improvement of the Texture and/or Appearance and/or Hair

To examine the effect of 2t2 on hair regrowth, dorsal hair of C57BL6/J mice (Jackson Laboratory) was first shortened with clippers followed by application of depilatory cream (Nair) to the shaved region for a period of 30 seconds before wiping clean. After 4 hours, 2t2 (3 mg/kg, single dose), low dose recombinant IL-2 (25000 IU, 5 consecutive days, 1 dose/day), or PBS were administered subcutaneously. The mice were monitored for skin pigmentation related to hair regrowth and pictures were taken and analyzed using the Image J software. FIG. 181A shows skin pigmentation 10 days after depilation in PBS-, 2t2-, or IL-2-treated mice. FIG. 181B shows the percent pigmentation in each group of mice 10 days post-treatment as analyzed using the Image J software. The results showed that treatment of mice with 2t2 or IL-2 promoted hair regrowth following depilation compared to PBS-treated mice.

Dorsal hair of C57BL6/J mice (Jackson Laboratory) was first shortened with clippers before applying depilatory cream (Nair) to the shaved region for a period of exactly 30 seconds before wiping clean. After 4 hours, 2t2 (3 mg/kg, single dose), low dose recombinant IL-2 (25000 IU, 5 consecutive days, 1 dose/day) or PBS were administered subcutaneously. The mice were monitored for skin pigmentation related to hair regrowth and pictures were taken and analyzed using Image J software. FIG. 182 shows skin pigmentation 14 days after depilation in PBS-, 2t2-, or IL-2-treated mice. The results showed that treatment of mice with 2t2 or IL-2 promoted hair regrowth following depilation compared to the PBS-treated mice.

Example 71: Tissue Factor Coagulation Assays Following Treatment with Single-Chain or Multi-Chain Chimeric Polypeptides A set of experiments was performed to assess blood coagulation following treatment with single-chain or multi-chain chimeric polypeptides. To initiate the blood coagulation cascade pathway, tissue factor (TF) binds to Factor VIIa (FVIIa) to form a TF/FVIIa complex. The TF/FVIIa complex then binds Factor X (FX) and converts FX to FXa.

Factor VIIa (FVIIa) Activity Assay

One assay to measure blood coagulation involves measuring Factor VIIa (FVIIa) activity. This type of assay requires the presence of tissue factor and calcium. The TF/FVIIa complex activity can be measured by a small substrate or by a natural protein substrate, for example, Factor X (FX). When FX is used as a substrate, phospholipids are also required for TF/FVIIa activity. In this assay, FVIIa activity is determined with FVIIa-specific chromogenic substrate S-2288 (Diapharma, West Chester, OH). The color change of the S-2288 substrate can be measured spectrophotometrically and is proportional to the proteolytic activity of FVIIa (e.g., the TF/FVIIa complex).

In these experiments, the FVIIa activity of the following groups were compared: the 219-amino acid extracellular domain of tissue factor domain ($TF_{219}$), a multi-chain chimeric polypeptide with a wild-type tissue factor domain, and a multi-chain chimeric polypeptide with a mutant tissue factor domain. The chimeric polypeptides containing mutant tissue factor molecules were constructed with mutations to the TF domain at amino acid sites: Lys20, Ile22, Asp58, Arg135, and Phe140.

In order to assess activity of FVIIa, FVIIa, and $TF_{219}$ or a $TF_{219}$-containing multi-chain chimeric polypeptide were mixed at an equal molar concentration (10 nM) in all wells of a 96-well ELISA plate in a total volume of 70 μL. After incubation for 10 minutes at 37° C., 10 μL of 8 mM S-2288 substrate was added to start the reaction. The incubation was then kept at 37° C. for 20 minutes. Finally, color change was monitored by reading absorbance at 405 nm. The OD values of different TF/VIIa complexes are shown in Table 1 and Table 2. Table 1 shows a comparison of $TF_{219}$, 21t15-21s wild-type (WT) and 21t15-21s mutant (Mut). Table 2 shows a comparison of $TF_{219}$, 21t15-TGFRs wild-type (WT), and 21t15-TGFRs mutant (Mut). These data show that $TF_{219}$-containing multi-chain chimeric polypeptides (e.g., 21t15-21s-WT, 21t15-21s-Mut, 21t15-TGFRS-WT, and 21t15-TGFRS-Mut) have lower FVIIa activity than $TF_{219}$ when the chromogenic S-2288 was used as a substrate. Notably, the multi-chain chimeric polypeptides containing $TF_{219}$ mutations showed much lower FVIIa activity when compared to multi-chain chimeric polypeptides containing wild type $TF_{219}$.

TABLE 1

| | FVIIa activity |
|---|---|
| Molecule | OD value at 405 nm |
| $TF_{219}$ | 0.307 |
| 21t15/21S-WT | 0.136 |
| 21t15/21S-Mut | 0.095 |

WT: wild type of $TF_{219}$, Mut: $TF_{219}$ containing mutations.

TABLE 2

| | FVIIa activity |
|---|---|
| Molecule | OD value at 405 nm |
| $TF_{219}$ | 0.345 |
| 21t15/TGFRS-WT | 0.227 |
| 21t15/TGFRS-Mut | 0.100 |

WT: wild type of $TF_{219}$,
Mut: $TF_{219}$ containing mutations.

Factor X (FX) Activation Assay

An additional assay to measure blood coagulation involves measuring activation of Factor X (FX). Briefly, TF/VIIa activates blood coagulation Factor X (FX) to Factor Xa (FXa) in the presence of calcium and phospholipids. $TF_{243}$, which contains the transmembrane domain of TF, has much higher activity in activating FX to FXa than $TF_{219}$, which does not contain the transmembrane domain. TF/VIIa dependent activation of FX is determined by measuring FXa activity using an FXa-specific chromogenic substrate S-2765 (Diapharma, West Chester, OH). The color change of S-2765 can be monitored spectrophotometrically and is proportional to the proteolytic activity of FXa.

In these experiments, FX activation with a multi-chain chimeric polypeptide (18t15-12s, mouse (m)21t15, 21t15-TGFRs, and 21t15-7s) was compared with a positive control (Innovin) or $TF_{219}$. $TF_{219}$ (or $TF_{219}$-containing multi-chain chimeric polypeptides)/FVIIa complexes were mixed at an equal molar concentration (0.1 nM each) in a volume of 50 μL in round bottom wells of a 96-well ELISA plate, after which 10 μL of 180 nM FX was added. After 15 minutes of incubation at 37° C., during which time FX was converted to FXa, 8 μL of 0.5 M EDTA (which chelates calcium and thus terminates FX activation by TF/VIIa) was added to each well to stop FX activation. Next, 10 μL of 3.2 mM S-2765 substrate was added to the reaction mixture. Immediately, the plate absorbance was measured at 405 nm and was recorded as the absorbance at time 0. The plate was then incubated for 10-20 minutes at 37° C. The color change was monitored by reading absorbance at 405 nm following the incubation. Results of FX activation as measured by FXa activity using chromogenic substrate S-2765 are shown in FIG. 183. In this experiment, Innovin, which is a commercial prothrombin reagent containing lipidated recombinant human $TF_{243}$, was used as a positive control for FX activation. Innovin was reconstituted with purified water to about 10 nM of $TF_{243}$. Next, 0.1 nM TF/VIIa complex was made by mixing an equal volume of 0.2 nM of FVIIa with 0.2 nM of Innovin. Innovin demonstrated very potent FX activation activity, while $TF_{219}$ and $TF_{219}$-containing multi-chain chimeric polypeptides had very low FX activation activity, confirming that $TF_{219}$ is not active in a TF/FVIIa complex for activating natural substrate FX in vivo.

Prothrombin Time Test

A third assay to measure blood coagulation is the prothrombin time (PT) test, which measures blood clotting activity. Here, the PT test was performed using commercially available normal human plasma (Ci-Trol Coagulation Control, Level I). For a standard PT test, clot reactions were initiated by addition of Innovin, a lipidated recombinant human $TF_{243}$, in the presence of calcium. Clotting time was monitored and reported by STart PT analyzer (Diagnostica Stago, Parsippany, N.J.). PT assays were started by injecting 0.2 mL of various dilutions of Innovin diluted in PT assay buffer (50 mM Tris-HCl, pH 7.5, 14.6 mM $CaCl_2$), 0.1% BSA) into cuvettes containing 0.1 mL of normal human plasma prewarmed at 37° C. In the PT assay, shorter PT time (clotting time) indicates a higher TF-dependent clotting activity while longer PT (clotting time) means lower TF-dependent clotting activity.

As seen in FIG. 184, addition of different amounts of Innovin (e.g., Innovin reconstituted with purified water equivalent to 10 nM of lipidated recombinant human $TF_{243}$ was considered to be 100% Innovin) to the PT assay demonstrated a dose-response relationship, where lower concentrations of $TF_{243}$ resulted in a longer PT time (lower clotting activity). For example, 0.001% Innovin had a PT time greater than 110 seconds, which was almost the same as buffer alone.

In another experiment, the PT test was conducted on $TF_{219}$ and multi-chain chimeric polypeptides including: 18t15-12s, 7t15-21s, 21t15-TGFRs-WT, and 21t15-TGFRs-Mut. FIG. 185 show that $TF_{219}$ and $TF_{219}$-containing multi-chain chimeric polypeptides (at a concentration of 100 nM) had prolonged PT times indicating extremely low or no clotting activity.

Studies were also conducted to evaluate whether incubating the multi-chain chimeric polypeptides in the presence of other cells carrying receptors for the cytokine components of the multi-chain chimeric polypeptide (32Dβ or human PBMCs) would affect the clotting time in the PT assay. To examine whether cells that express IL-15 receptor (32Dβ cells) or IL-15 and IL-21 receptors (PBMCs) would bind IL-15-containing multi-chain chimeric polypeptides to mimic natural TF as a cellular FVIIa receptor, $TF_{219}$-containing multi-chain chimeric polypeptides (at a concentration of 100 nM for each molecule) were diluted in the PT assay buffer and preincubated with 32Dβ cells (at $2 \times 10^5$ cells/mL) or PBMC (at $1 \times 10^5$ cells/mL) for 20-30 minutes at room temperature. The PT assay was then conducted as described above. FIGS. 186 and 187 shows that $TF_{219}$ and $TF_{219}$-containing multi-chain chimeric polypeptides mixed with 32Dβ cells (FIG. 186) or PBMC (FIG. 187) at a final concentration of 100 nM had prolonged PT times similar to 0.001-0.01% Innovin (equivalent to 0.1 pM to 1.0 pM of $TF_{243}$). Expressed in percentage of relative $TF_{243}$ activity, $TF_{219}$-containing multi-chain chimeric polypeptides had 100,000 to 1,000,000 times lower TF dependent clotting activity when compared to Innovin. This demonstrated that $TF_{219}$-containing multi-chain chimeric polypeptides had extremely low or no TF-dependent clotting activity, even while the molecules were bound to an intact cell membrane surface, such as 32Dβ or PBMCs.

Example 72: Characterization of 7t15-21s137L (Long Version)

The nucleic acid sequence of the 7t15 construct (including signal peptide sequence) is as follows (SEQ ID NO: 210):

(Signal peptide)
ATGAAGTGGGTGACCTTCATCAGCCTGCTGTTCCTGTTCTCCAGCGCCT
ACTCC (Human IL7)
GATTGCGACATCGAGGGCAAGGACGGCAAGCAGTACGAGAGCGTGCTGA
TGGTGTCCATCGACCAGCTGCTGGACAGCATGAAGGAGATCGGCTCCAA
CTGCCTCAACAACGAGTTCAACTTCTTCAAGCGGCACATCTGCGACGCC
AACAAGGAGGGCATGTTCCTGTTCAGGGCCGCCAGGAAACTGCGGCAGT
TCCTGAAGATGAACTCCACCGGCGACTTCGACCTGCACCTGCTGAAGGT
GTCCGAGGGCACCACCATCCTGCTGAACTGCACCGGACAGGTGAAGGGC
CGGAAACCTGCTGCTCTGGGAGAGGCCCAACCCACCAAGAGCCTGGAGG
AGAACAAGTCCCTGAAGGAGCAGAAGAAGCTGAACGACCTGTGCTTCCT
GAAGAGGCTGCTGCAGGAGATCAAGACCTGCTGGAACAAGATCCTGATG
GGCACCAAGGAGCAT (Human Tissue Factor 219)
AGCGGCACAACCAACACAGTCGCTGCCTATAACCTCACTTGGAAGAGCA
CCAACTTCAAAACCATCCTCGAATGGGAACCCAAACCCGTTAACCAAGT
TTACACCGTGCAGATCAGCACCAAGTCCGGCGACTGGAAGTCCAAATGT
TTCTATACCACCGACACCGAGTGCGATCTCACCGATGAGATCGTGAAAG
ATGTGAAACAGACCTACCTCGCCCGGGTGTTTAGCTACCCCGCCGGAAA
TGTGGAGAGCACTGGTTCCGCTGGCGAGCCTTTATACGAGAACAGCCCC
GAATTTACCCCTTACCTCGAGACCAATTTAGGACAGCCCACCATCCAAA
GCTTTGAGCAAGTTGGCACAAAGGTGAATGTGACAGTGGAGGACGAGCG
GACTTTAGTGCGGCGGAACAACACCTTTCTCAGCCTCCGGGATGTGTTC
GGCAAAGATTTAATCTACACACTGTATTACTGGAAGTCCTCTTCCTCCG
GCAAGAAGACAGCTAAAACCAACACAAACGAGTTTTTAATCGACGTGGA
TAAAGGCGAAAACTACTGTTTCAGCGTGCAAGCTGTGATCCCCTCCCGG
ACCGTGAATAGGAAAAGCACCGATAGCCCCGTTGAGTGCATGGGCCAAG
AAAAGGGCGAGTTCCGGGAG (Human IL-15)
AACTGGGTGAACGTCATCAGCGATTTAAAGAAGATCGAAGATTTAATTC
AGTCCATGCATATCGACGCCACTTTATACACAGAATCCGACGTGCACCC
CTCTTGTAAGGTGACCGCCATGAAATGTTTTTTACTGGAGCTGCAAGTT
ATCTCTTTAGAGAGCGGAGACGCTAGCATCCACGACACCGTGGAGAATT
TAATCATTTTAGCCAATAACTCTTTATCCAGCAACGGCAACGTGACAGA
GTCCGGCTGCAAGGAGTGCGAAGAGCTGGAGGAGAAGAACATCAAGGAG
TTTCTGCAATCCTTTGTGCACATTGTCCAGATGTTCATCAATACCTCC The amino acid sequence of 7t15 fusion protein (including the leader sequence) is as follows (SEQ ID NO: 209):

(Signal peptide)
MKWVTFISLLFLFSSAYS (Human IL7)
DCDIEGKDGKQYESVLMVSIDQLLDSMKEIGSNCLNNEFNFFKRHICDA
NKEGMFLFRAARKLRQFLKMNSTGDFDLHLLKVSEGTTILLNCTGQVKG
RKPAALGEAQPTKSLEENKSLKEQKKLNDLCFLKRLLQEIKTCWNKILM
GTKEH (Human Tissue Factor 219)
SGTTNTVAAYNLTWKSTNFKTILEWEPKPVNQVYTVQISTKSGDWKSKC
FYTTDTECDLTDEIVKDVKQTYLARVFSYPAGNVESTGSAGEPLYENSP
EFTPYLETNLGQPTIQSFEQVGTKVNVTVEDERTLVRRNNTFLSLRDVF
GKDLIYTLYYWKSSSSGKKTAKTNTNEFLIDVDKGENYCFSVQAVIPSR
TVNRKSTDSPVECMGQEKGEFRE (Human IL-15)
NWVNVISDLKKIEDLIQSMHIDATLYTESDVHPSCKVTAMKCFLLELQV
ISLESGDASIHDTVENLIILANNSLSSNGNVTESGCKECEELEEKNIKE
FLQSFVHIVQMFINTS The nucleic acid sequence of the 21s137L construct (including signal peptide sequence) is as follows (SEQ ID NO: 331):

(Signal peptide)
ATGAAGTGGGTGACCTTCATCAGCCTGCTGTTCCTGTTCTCCAGCGCCT
ACTCC (Human IL-21)
CAGGGCCAGGACAGGCACATGATCCGGATGAGGCAGCTCATCGACATCG
TCGACCAGCTGAAGAACTACGTGAACGACCTGGTGCCCGAGTTTCTGCC
TGCCCCGAGGACGTGGAGACCAACTGCGAGTGGTCCGCCTTCTCCTGC

```
-continued
TTTCAGAAGGCCCAGCTGAAGTCCGCCAACACCGGCAACAACGAGCGGA
TCATCAACGTGAGCATCAAGAAGCTGAAGCGGAAGCCTCCCTCCACAAA
CGCCGGCAGGAGGCAGAAGCACAGGCTGACCTGCCCCAGCTGTGACTCC
TACGAGAAGAAGCCCCCAAGGAGTTCCTGGAGAGGTTCAAGTCCCTGC
TGCAGAAGATGATCCATCAGCACCTGTCCTCCAGGACCCACGGCTCCGA
GGACTCC (Human IL-15R α sushi domain)
ATTACATGCCCCCCTCCCATGAGCGTGGAGCACGCCGACATCTGGGTGA
AGAGCTATAGCCTCTACAGCCGGGAGAGGTATATCTGTAACAGCGGCTT
CAAGAGGAAGGCCGGCACCAGCAGCCTCACCGAGTGCGTGCTGAATAAG
GCTACCAACGTGGCTCACTGGACAACACCCTCTTTAAAGTGCATCCGG ((G4S)3 linker)
GGCGGTGGAGGATCCGGAGGAGGTGGCTCCGGCGGCGGAGGATCT (Human CD137L)
CGCGAGGGTCCCGAGCTTTCGCCCGACGATCCCGCCGGCCTCTTGGACC
TGCGGCAGGGCATGTTTGCGCAGCTGGTGGCCCAAAATGTTCTGCTGAT
CGATGGGCCCCTGAGCTGGTACAGTGACCCAGGCCTGGCAGGCGTGTCC
CTGACGGGGGGCCTGAGCTACAAAGAGGACACGAAGGAGCTGGTGGTGG
CCAAGGCTGGAGTCTACTATGTCTTCTTTCAACTAGAGCTGCGGCGCGT
GGTGGCCGGCGAGGGCTCAGGCTCCGTTTCACTTGCGCTGCACCTGCAG
CCACTGCGCTCTGCTGCTGGGGCCGCCGCCCTGGCTTTGACCGTGGACC
TGCCACCCGCCTCCTCCGAGGCTCGGAACTCGGCCTTCGGTTTCCAGGG
CCGCTTGCTGCACCTGAGTGCCGGCCAGCGCCTGGGCGTCCATCTTCAC
ACTGAGGCCAGGGCACGCCATGCCTGGCAGCTTACCCAGGGCGCCACAG
TCTTGGGACTCTTCCGGGTGACCCCCGAAATCCCAGCCGGACTCCCTTC
ACCGAGGTCGGAA
```

The amino acid sequence of 21s137L fusion protein (including the leader sequence) is as follows (SEQ ID NO: 332):

```
(Signal peptide)
MKWVTFISLLFLFSSAYS
(Human IL-21)
QGQDRHMIRMRQLIDIVDQLKNYVNDLVPEFLPAPEDVETNCEWSAFSC
FQKAQLKSANTGNNERIINVSIKKLKRKPPSTNAGRRQKHRLTCPSCDS
YEKKPPKEFLERFKSLLQKMIHQHLSSRTHGSEDS (Human IL-15R α sushi domain)
ITCPPPMSVEHADIWVKSYSLYSRERYICNSGFKRKAGTSSLTECVLNK
ATNVAHWTTPSLKCIR ((G4S)3 linker)
GGGGSGGGGSGGGGS (Human CD137L)
REGPELSPDDPAGLLDLRQGMFAQLVAQNVLLIDGPLSWYSDPGLAGVS
LTGGLSYKEDTKELVVAKAGVYYVFFQLELRRVVAGEGSGSVSLALHLQ
PLRSAAGAAALALTVDLPPASSEARNSAFGFQGRLLHLSAGQRLGVHLH
TEARARHAWQLTQGATVLGLFRVTPEIPAGLPSPRSE
```

The following experiment was conducted to evaluate whether the CD137L portion in 7t15-21s137L was intact to bind to CD137 (4.1BB). On day 1, a 96-well plate was coated with 100 μL (2.5 μg/mL) of GAH IgG Fc (G-102-C, R&D Systems) in R5 (coating buffer), overnight. On day 2, the plates were washed three times and blocked with 300 μL of 1% BSA in PBS at 37° C. for 2 hrs. 10 ng/ml of 4.1BB/Fc (838-4B, R&D Systems) was added at 100 μl/well for 2 hrs at room temperature. Following three washes, 7t15-21s137L (long version) or 7t15-21s137Ls (short version) was added starting at 10 nM, or recombinant human 4.1BBL starting at 180 ng/mL, with 1/3 dilution, followed by incubation at 4° C. overnight. On day 3, the plates were washed three times, and 500 ng/mL of biotinylate-goat anti-human 4.1BBL (BAF2295, R&D Systems) was applied at 100 μL per well, followed by incubation at RT for 2 hrs. The plates were washed three times, and incubated with 0.25 pg/mL of HRP-SA (Jackson ImmuneResearch) at 100 μL per well for 30 min. The plates were then washed three times, and incubated with 100 μL of ABTS for 2 mins at RT. The results were read at 405 nm. As shown in FIG. 188, both 7t15-21s137L (long version) and 7t15-21s137L (short version) could interact with 4.1BB/Fc (dark diamond and gray square) compared to the recombinant human 4.1 BB ligand (rhCD137L, light gray star). 7t15-21s137L (long version) (dark diamond) interacted better with 4.1BB/Fc as compared to 7t15-21s137L (short version) (gray square).

The following experiments were conducted to evaluate whether the components IL7, IL21, IL15, and 4.1BBL in 7t15-21s137L (long version) were intact to be detected by the individual antibody using ELISA. A 96-well plate was coated with 100 μL (4 μg/mL) of anti-TF (human IgG1) in R5 (coating buffer) and incubated at RT for 2 hrs. The plates were washed three times, and blocked with 100 μL of 1% BSA in PBS. Purified 7t15-21s137L (long version) was added starting at 10 nM, and at 1/3 dilution, followed by incubation at RT for 60 min. The plates were washed three times, and 500 ng/mL of biotinylate-anti-IL7 (506602, R&D Systems), 500 ng/mL of biotinylate-anti-IL21 (13-7218-81, R&D Systems), 50 ng/mL of biotinylate-anti-IL15 (BAM247, R&D Systems), or 500 ng/ml of biotinylate-goat anti-human 4.1BBL (BAF2295, R&D Systems) was added per well and incubated at room temperature for 60 min. The plates were washed three times and incubated with 0.25 μg/mL of HRP-SA (Jackson ImmunoResearch) at 100 μL per well for 30 min at RT. The plates were washed four times, and incubated with 100 μL of ABTS for 2 mins at room temperature. The absorbance results were read at 405 nm. As shown in FIG. 189A-189D, the components including IL7, IL21, IL15, and 4.1BBL in 7t15-21s137L (long version) were detected by the individual antibodies.

The following experiment was conducted to evaluate the activity of IL15 in 7t15-21s137L (long version) and 7t15-21s137L (short version). The ability of 7t15-21s137L (long version) and 7t15-21s137L (short version) to promote proliferation of IL2Rαβγ-expressing CTLL2 cells was compared with that of recombinant IL15. IL15 dependent CTLL2 cells were washed five times with IMDM-10% FBS and seeded to the wells at $2 \times 10^4$ cells/well. Serially diluted 7t15-21s137L (long version), 7t15-21s137L (short version), or IL15 were added to the cells. Cells were incubated in a $CO_2$ incubator at 37° C. for 3 days. Cell proliferation was detected by adding 20 μL of PrestoBlue (A13261, ThermoFisher) to each well on day 3 and incubated for an additional 4 hours in a $CO_2$ incubator at 37° C. Raw absorbance at 570-610 nm was read in a micro-titer plate reader. As shown in FIG. 190, 7t15-21s137L (long version), 7t15-21s137L (short version), and IL15 all promoted CTLL2 cell proliferation. The $EC_{50}$ of 7t15-21s137L (long version), 7t15-21s137L (short version), and IL15 is 51.19 pM, 55.75 pM, and 4.947 pM, respectively.

Example 73: Induction of Treg Cells by 2t2

The peripheral blood mononuclear cells (PBMC) of a heathy donor (Donor 163) were isolated from 5 mL of whole blood buffy coats by Ficoll Paque Plus (GE17144003). The PBMC were then lysed with ACK to remove red blood cells. Cells were washed with IMDM-10% FBS and counted. $1.8 \times 10^6$ cells (100 μL/tube) were seeded to the flow tubes and incubated with 50 μL of descending 2t2 or IL2 (15000, 1500, 150, 15, 1.5, 0.15, or 0 pM) and 50 μL of pre-staining antibodies (anti-CD8-BV605 and anti-CD127-AF647). Cells were incubated for 30 min at 37° C. in water bath. 200 μL of pre-warmed BD Phosflow Fix Buffer I (Cat #557870, Becton Dickinson Biosciences) was added for 10 min at 37° C. in water bath to stop the stimulation. Cells ($4.5 \times 10^5$ cells/100 μL) were transferred to a V-shape 96-well plate and were spun down followed by permeabilization with 100 µL of −20° C. pre-cooled BD Phosflow Perm Buffer III (Cat #BD Biosciences) for 30 min on ice. The cells were then extensively washed ×2 with 200 µL of FACS buffer and stained with a panel of fluorescent antibodies (anti-CD25-PE, CD4-PerCP-Cy5.5, CD56-BV421, CD45RA-PE-Cy7 and pSTAT5a-AF488) to distinguish between different lymphocyte subpopulations and evaluate the pSTAT5a status. Cells were spun down and resuspended in 200 µL of FACS buffer for FACSCelesta analysis. As shown in FIG. 191A, 6 pM of 2t2 was sufficient to induce the phosphorylation of Stat5a in CD4$^+$CD25$^{hi}$ T$_{reg}$ cells while 43.11 pM of IL-2 was required to induce phosphorylation of Stat5a in the same population of lymphocytes. In contrast, 2t2 was less active (FIG. 191B) or equally active (FIG. 191C) as compared to IL2 in inducing phosphorylation of Stat5a in CD4$^+$CD25$^-$ T$_{con}$ and CD8$^+$ T$_{con}$ cells. These results suggest that 2t2 is superior as compared to IL2 in activating Tre g in human PBMC, and that 2t2 demonstrates increased T$_{reg}$ selectivity compared to IL-2 in human blood lymphocyte pStat5a responses.

Example 74. Improvement in Hair Growth Using a Single-Chain Chimeric Polypeptide The dorsal hair of 7-week-old C57BL6/J mice was shaved and depilated using commercial depilatory cream. The mice were injected on the same day subcutaneously with a single dose of 2t2 or low dose commercially available recombinant IL-2, followed by daily dosing for four additional days. Untreated mice served as controls. On day 10, the mice were sacrificed and skin sections of the shaved areas were prepared. Representative H&E staining of skin sections from C57BL6J mice on day 10 following depilation are shown in FIGS. 192A-192E. FIG. 192A shows control mice—only depilation done after hair was shaved, FIG. 192B shows mice where depilation was followed by low dose IL-2 (1 mg/kg) administration, and FIGS. 192C-192E shows mice where depilation was followed by 2t2 administered at 0.3 mg/kg (FIG. 192C), 1 mg/kg (FIG. 192D), and 3 mg/kg (FIG. 192E). Black arrows indicate anagen-phase hair follicles that will later extend into dermis and facilitate hair growth. FIG. 194 shows the total number of anagen phase hair follicles counted per 10 fields for each treatment group. In summary, the data show that the 2t2 molecule resulted in increased numbers of anagen-phase hair follicles compared to depilation alone. This effect was also dose-dependent.

Example 75: Differentiation of the Immune Cell into a Memory-Like Immune Cell

Fresh human leukocytes were obtained from the blood bank and CD56$^+$ NK cells were isolated with the RosetteSep/human NK cell reagent (StemCell Technologies). The purity of NK cells was >70% and confirmed by staining with CD56-BV421, CD16-BV510, CD25-PE, CD69-APC-Fire750 (BioLegend). The cells were counted and resuspended at a density of 2×10$^6$ cells/mL in RPMI 1640 medium (Gibco) supplemented with 2 mM L-glutamine (Thermo Life Technologies), antibiotics (penicillin, 10,000 units/mL; streptomycin, 10,000 µg/mL; Thermo Life Technologies), and 10% FBS (Hyclone). The cells (1 mL) were transferred into a 24-well flat bottom plate, and subjected to either: no treatment, or expanded with 7t15-21s+anti-tissue factor (TF)-antibody (IgG1) (50 nM) for 14 days with medium. The cells were replenished with fresh 7t15-21s+ anti-TF-antibody (IgG1) (50 nM) to keep the cell density at approximately 1×10$^6$ cells/mL.

Unexpanded NK cells to treatment groups were used as positive controls for full DNA methylation levels (Data not shown). NK cells were pelleted (1×10$^6$), and genomic DNA (nDNA) isolated using the QIAamp UCP DNA Micro Kit (Qiagen). 500 ng of purified nDNA was subjected to sodium bisulfite treatment using the EZ DNA Methylation-Direct kit (Zymo Research) according to the manufacturer's protocol. Bisulfite treatment introduces methylation-dependent changes in the DNA with demethylated cytosines being converted into uracil, whereas methylated cytosines remain unchanged. The bisulfite-treated nDNA (10-50 ng) was used as template to PCR amplify a 228 bp region of the IFNγ promoter containing two CpG sites (CpG-186 and CpG-54, position relative to the transcription start site, TSS), known to be heavily regulated by DNA methylation in T cells, using the Pyromark PCR kit (Qiagen) with the forward primer IFNG127F (5'-ATGGTATAGGTGGGTATAATGG-3') and the biotinylated reverse primer IFNG355R-bio (biotin-5'-CAATATACTA-CACCTCCTCTAACTAC-3') (GENEWIZ). The PCR conditions were 15 minutes at 95° C., 48 cycles of 30 seconds at 95° C., 30 seconds at 56° C., 60 seconds at 72° C. followed by 10 minutes at 72° C. The integrity and quality of the PCR amplified products were visualized on a 1.2% TAE agarose gel. The DNA methylation status of these two CpG sites was determined by pyrosequencing, which is the gold standard technique to quantitatively measure DNA methylation at single CpG-site. Pyrosequencing reactions were performed at Johns Hopkins University Genetic Resources Core Facility using the DNA sequencing primers C186-IFNG135F (5'-GGTGGGTATAATGGG-3') (SEQ ID NO: 333) and C54-IFNG261F (5'-ATTATTTTATTT-TAAAAAATTTGTG-3') (SEQ ID NO: 334), specific to the CpG sites −186 and −54, respectively. Commercially available non-methylated and methylated DNA (Zymo Research) were used as controls for DNA methylation. The methylation percentages of the two CpG sites (−186 and −54) were pooled for each treatment. The percent difference in DNA methylation was calculated relative to the levels of DNA methylation at the two CpG sites observed in unexposed NK cells.

Analysis of the DNA methylation status of these two IFNγ CpG sites revealed higher levels of DNA demethylation in NK cells supported by 7t15-21s+anti-TF-antibody compared to unexposed NK cells (FIG. 194). These 7t15-21s+ anti-TF-antibody supported NK cells exhibited 47.70%±11.76 difference in DNA methylation (i.e., demethylation) compared to unexposed NK cells. The DNA methylation levels of these two IFNγ CpG sites correlated with increased expression of IFNγ following treatment with 7t15-21s+anti-TF-antibody. These data suggest that long-term exposure of NK cells (14 days expansion in culture) with a combination regimen of 7t15-21s+anti-TF-antibody is able to induce DNA demethylation of the two hypomethylated IFNγ CpG sites (−186 and −54) and that 7t15-21s+anti-TF-antibody (IgG1) can epigenetically reprogram gene expression of IFNγ via DNA demethylation of CpG sites leading to interconversion of NK cells into innate immune memory NK cells.

Example 76: Chemotherapy Induces p21$^{CIP1}$p21 Senescence-Associated Gene Expression in C57BL/6 Mice Chemotherapy induces p21$^{CIP1}$p21 senescence-associated gene expression in C57BL/6 Mice. FIG. 203A is a schematic showing the treatment regimen. C57BL/6 mice were treated with three doses of chemotherapy docetaxel (DTX) (10 mg/kg) at day 1, day 4 and day 7. At day 9 the mice were sacrificed, and lung and liver tissues were harvested to evaluate the senescence markers. FIGS. 203B and 203C show expression of $p21^{CIP1}p21$ in lung (B) and liver (C) tissues respectively. Lung and liver tissues were homogenized by using mortar and pestle in liquid nitrogen. Homogenized tissues were transferred in fresh Eppendorf tubes containing 1 mL of Trizol (Thermo Fischer). Total RNA was extracted using RNeasy Mini Kit (Qiagen #74106) according to the manufacturer's instructions. 1 mg of total RNA was used for cDNA synthesis using the QuantiTect Reverse Transcription Kit (Qiagen). Real-time PCR was carried out with CFX96 Detection System (Bio-Rad) using FAM labeled predesigned primer $p21^{CIP1}p21$ were purchased from Thermo Scientific. Reactions were run in triplicate for all the genes examined. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct=Ct_{target}-Ct_{18S}$. As shown in FIGS. 203A-203C, the senescence marker $p21^{CIP1}p21$ was induced in the lung and liver tissues of mice treated with docetaxel.

Example 77: Immuno-Phenotype and Cell Proliferation Following Treatment with IL-15-Based Agents (Day 3 Post Treatment)

The mouse blood was prepared in order to evaluate the different subsets of immune cells after treatment with TGFRt15-TGFRs. C57BL/6, 6-week-old mice were purchased from The Jackson Laboratory. Mice were housed in a temperature and light controlled environment. Mice were divided into groups as follows: Saline control group (n=6), docetaxel group (n=6), docetaxel with TGFRt15-TGFRs group (n=6) and docetaxel with IL-15SA group (n=6). The IL-15 superagonist (IL-15SA) was constructed and administered as previously described (Zhu et al., *J. Immunol.* 183(6):3598-3607, 2009). Senescence was induced in mice with three doses of docetaxel (10 mg/kg) at day 1, 4 and 7. On day 8, mice were treated subcutaneously with either PBS or with TGFRt15-TGFRs (3 mg/kg) or with IL-15SA (0.2 mg/kg). The mouse blood was collected from submandibular vein on Day 3 post treatment in EDTA contained tubes. The whole blood was centrifuged to collect plasma @ 3000 RPM for 10 minutes in a micro centrifuge. Plasma was stored at −80° C. and whole blood was processed for immune cells phenotyping by flow cytometry. Whole bloods were lysed in ACK buffer for 5 minutes at room temperature. Cell were washed in FACS buffer (1×PBS (Hyclone) with 0.5% BSA (EMD Millipore) and 0.001% Sodium Azide (Sigma)). To assess the different types of immune cells in blood, cells were stained for cell-surface CD4, CD45, CD8 and NK1.1 (BioLegend) for 30 minutes at RT. After surface staining, cells were washed (1500 RPM for 5 minutes at room temperature) in FACS buffer (1×PBS (Hyclone) with 0.5% BSA (EMD Millipore) and 0.001% Sodium Azide (Sigma)). Cells were treated with permeabilization buffer (Invitrogen) for 20 min at 4° C. followed by wash with Perm buffer (Invitrogen). Cells were then stained for intracellular markers (Ki67) and FoxP3 for 30 min at room temperature. After two washes, cells were resuspended in fixation buffer and analyzed by Flow Cytometry (Celesta-BD Bioscience). These data show that IL-15-based agents TGFRt15-TGFRs and IL-15SA can stimulate and promote the expansion and proliferation of NK and CD8⁺ T cells after docetaxel treatment (FIG. 204).

Example 78: TGFRt15-TGFRs Treatment Reduces Senescence-Associated Gene Expression in C57BL/6 Mice Chemotherapy induced senescence-associated gene expression was significantly reduced with TGFRt15-TGFRs in the lung and liver of C57BL/6 mice. C57BL/6 mice were treated with three doses of chemotherapy docetaxel (10 mg/kg) at day 1, day 4 and day 7. On day 8, docetaxel treated mice were divided into three groups. The first group received no treatment, second group received TGFRt15-TGFRs and third group received IL-15SA. Saline treated mice were used as controls. The TGFRt15-TGFRs was administered at a dosage of 3 mg/kg and IL-15SA was administered at 0.2 mg/kg. On Day 3 post-study drug treatment, the mice were sacrificed and lung and liver were collected. FIGS. 205A-205C show expression of $p21^{CIP1}p21$ and CD26 in lung (A and B) and $p21^{CIP1}p21$ in liver (C) tissues respectively. Lung and liver tissues were homogenized by using mortar and pestle in liquid nitrogen. Homogenized tissues were transferred in fresh Eppendorf tubes containing 1 mL of Trizol (Thermo Fischer). Total RNA was extracted using RNeasy Mini Kit (Qiagen #74106) according to the manufacturer's instructions. 1 μg of total RNA was used for cDNA synthesis using the QuantiTect Reverse Transcription Kit (Qiagen). Real-time PCR was carried out with CFX96 Detection System (Bio-Rad) using FAM labeled predesigned primers $p21^{CIP}1p21$ and CD26 were purchased from Thermo Scientific. Reactions were run in triplicate for all the genes examined. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct=Ct_{target}-Ct_{18S}$.

As shown in FIGS. 205A-205C, the therapy-induced senescence marker $p21^{CIP1}p21$ was significantly reduced in the lung and liver tissues of mice treated with TGFRt15-TGFRs. The therapy-induced senescence marker CD26 was also significantly reduced in the lung tissues of mice treated with TGFRt15-TGFRs.

Example 79: Immuno-Phenotype Following Treatment with IL-15-Based Agents

The mouse blood was prepared in order to evaluate the different subsets of immune cells after treatment with IL-15-based agents: TGFRt15-TGFRs, an IL-15 superagonist (IL-15SA) and an IL-15 fusion with a D8N mutant knocking out the IL-15 activity (TGFRt15*-TGFRs). C57BL/6, 6-week-old mice were purchased from The Jackson Laboratory. Mice were housed in a temperature and light controlled environment. Mice were divided into groups (n=6/group) and treated with the following: 1) PBS (saline) control, 2) docetaxel, 3) docetaxel with TGFRt15-TGFRs, 4) docetaxel with IL-15SA, 5) docetaxel with an IL-15 mutant (TGFRt15*-TGFRs) and 6) docetaxel with an IL-15 superagonist (IL-15SA) plus TGFRt15*-TGFRs. Senescence was induced in mice with three dose of docetaxel (10 mg/kg) at day 1, 4 and 7. On day 8, the mice were treated subcutaneously with PBS, TGFRt15-TGFRs, TGFRt15*-TGFRs, IL-15SA or in combinations as discussed above. TGFRt15-TGFRs and TGFRt15*-TGFRs were administered at a dosage of 3 mg/kg and IL-15SA was administered at 0.05 mg/kg. The mouse blood was collected from the submandibular vein on day 3 post-study drug treatment into EDTA tubes. The whole blood was centrifuged to collect plasma at 3000 RPM for 10 minutes in a micro centrifuge. Plasma was stored at −80° C. and whole blood was processed for immune cell phenotyping by flow cytometry. Whole blood was lysed in ACK buffer for 5 minutes at 37° C. Cell were washed in FACS buffer (1×PBS (Hyclone) with 0.5% BSA (EMD Millipore) and 0.001% Sodium Azide (Sigma)). To assess the different types of immune cells in the blood, cells were stained for cell-surface CD4, CD45, CD19 CD8 and NK1.1 (BioLegend) for 30 minutes at room temperature (RT). After surface staining, cells were washed (1500 RPM for 5 minutes at room temperature) in FACS buffer (1×PBS (Hyclone) with 0.5% BSA (EMD Millipore) and 0.001% Sodium Azide (Sigma)). Cells were treated with permeabilization buffer (Invitrogen) for 20 min at 4° C. followed by wash with Perm buffer (Invitrogen). Cells were then stained for intracellular markers (Ki67) for 30 min at RT. After two washes, cells were resuspended in fixation buffer and analyzed by Flow Cytometry (Celesta-BD Bioscience) (FIGS. 206 and 207).

These data show that IL-15-based agents TGFRt15-TGFRs and IL-15SA can stimulate and promote the expansion and proliferation of NK and CD8$^+$ T cells after docetaxel treatment. Increased NK and CD8$^+$ T cell expansion and proliferation was not seen with fusion proteins lacking IL-15 activity (i.e., TGFRt15*-TGFRs).

Example 80: Evaluation of Senescence Markers p21$^{CIP1}$p21 and CD26 in Lung and Liver Tissues Markers for cellular senescence were evaluated in tissues of normal mice following chemotherapy and administration of study treatments. C57BL/6, 6-week-old mice were purchased from The Jackson Laboratory. Mice were housed in a temperature and light controlled environment. Mice were divided into six groups and treated with the following: 1) PBS (saline) control (n=5), 2) docetaxel (n=8), 3) docetaxel with TGFRt15-TGFRs (n=8), 4) docetaxel with IL15SA (n=8), 5) docetaxel with an IL-15 mutant (TGFRt15*-TGFRs) (n=8) and 6) docetaxel with an IL-15 superagonist (IL-15SA) plus TGFRt15*-TGFRs (n=6). Senescence was induced in mice with three doses of docetaxel (10 mg/kg) at day 1, 4 and 7. On day 8, the mice were treated subcutaneously with PBS, TGFRt15-TGFRs, TGFRt15*-TGFRs, IL-15SA or in combinations as discussed below. TGFRt15-TGFRs and TGFRt15*-TGFRs were administered at a dosage of 3 mg/kg and IL-15SA was administered at 0.05 mg/kg. The mouse tissues were prepared in order to evaluate the different senescence markers. Mice were euthanized on day 7 post-study drug treatment and the liver and lung tissues were harvested and stored in liquid nitrogen in 1.7 mL Eppendorf tubes. Samples were homogenized by using mortar and pestle in liquid nitrogen. Homogenized tissues were transferred in fresh Eppendorf tubes containing 1 mL of Trizol (Thermo Fischer). Total RNA was extracted using RNeasy Mini Kit (Qiagen #74106) according to the manufacturer's instructions and 1 μg of total RNA was used for cDNA synthesis using the QuantiTect Reverse Transcription Kit (Qiagen). Real-time PCR was carried out with CFX96 Detection System (Bio-Rad) using FAM labeled predesigned primers purchased from Thermo Scientific. Reactions were run in triplicate for all the genes examined. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct=Ct_{target}-Ct_{18S}$. As shown in FIGS. 208A-208C, the senescence markers p21 and CD26 were induced in the lung [(A) and (B), respectively] and p21$^{CIP1}$p21 in liver (C) tissues of mice treated with docetaxel. The senescence markers p21$^{CIP1}$p21 and CD26 in the lungs and p21$^{CIP1}$p21 in the liver were reduced of the mice treated with TGFRt15-TGFRs, IL-15SA and combination of IL-15SA and TGFRt15*-TGFRs mutant. However, the TGFRt15*-TGFRs mutant treated mice lung failed to eliminate the senescence markers in these tissues. These results show that IL-15 activity is important for clearance of TIS senescence cells.

Example 81: Immuno-Phenotype Following Treatment with TGFRt15-TGFRs

The mouse blood was prepared in order to evaluate the different subsets of immune cells after treatment with TGFRt15-TGFRs. C57BL/6, 76-week-old aged mice were purchased from The Jackson Laboratory. Mice were housed in a temperature and light controlled environment. Mice were divided into two groups as follows: PBS control group (n=6) and TGFRt15-TGFRs group (n=6). Mice were treated subcutaneously with either PBS or with TGFRt15-TGFRs at a dosage of 3 mg/kg on Day 0. On Day 4 following the first dose of study treatment, the mouse blood was collected from the submandibular vein in EDTA contained tubes. The whole blood was centrifuged to collect plasma at 3000 RPM for 10 minutes in a micro centrifuge. Plasma was stored at −80° C. and the blood was processed for immune cell phenotyping by flow cytometry. Whole blood was lysed in ACK buffer for 5 minutes at room temperature. Cells were washed in FACS buffer (1×PBS (Hyclone) with 0.5% BSA (EMD Millipore) and 0.001% Sodium Azide (Sigma)). To assess the different types of immune cells in blood, cells were stained for cell-surface CD4, CD45, CD19 CD8 and NK1.1 (BioLegend) for 30 minutes at room temperature (RT). After surface staining, cells were washed (1500 RPM for 5 minutes at RT) in FACS buffer (1×PBS (Hyclone) with 0.5% BSA (EMD Millipore) and 0.001% Sodium Azide (Sigma)). Cells were treated with permeabilization buffer (Invitrogen) for 20 min at 4° C. followed by wash with Penn buffer (Invitrogen). Cells were then stained for intracellular markers (Ki67) for 30 min at RT. After two washes, cells were resuspended in fixation buffer and analyzed by flow cytometry (Celesta-BD Bioscience).

As shown in FIG. 195, the percentages of CD8$^+$ T cells and proliferation of CD8$^+$ T cells, which was measured by Ki67, significantly increased, 4 days after the first dose of TGFRt15-TGFRs. We also observed an increase in NK cells and proliferation of NK cells as shown in FIG. 196. We observed significant decreases in CD19$^+$ cells after the first dose of TGFRt15-TGFRs. These results demonstrate that a single dose of TGFRt15-TGFRs administered subcutaneously can stimulate immune cells, such as CD8$^+$ T cells and NK cells to proliferate in the blood of aged mice.

Example 82: TGFRt15-TGFRs Reduces Senescence-Associated β-Gal from Liver and Lung Tissues The mouse liver and lungs were prepared in order to evaluate the senescence-associated β-gal in tissues after treatment with TGFRt15-TGFRs. C57BL/6, 76-week-old aged mice were purchased from The Jackson Laboratory. Mice were housed in a temperature and light controlled environment. Mice were divided into two groups as follows: PBS control group (n=6) and TGFRt15-TGFRs group (n=6). Mice were treated subcutaneously with either PBS or with TGFRt15-TGFRs at a dosage of 3 mg/kg on Day 0 and Day 10. On Day 7 following the second dose of study treatment, mice were euthanized and liver and lungs were harvested, homogenized in PBS containing 2% PBS, and filtered in 70-micron filter to obtain a single cell suspension. Cells were spun down then resuspended in 5 mL RPMI containing 0.5 mg/mL collagenase IV and 0.02 mg/mL DNAse in 14 mL round bottom tubes. Then, the cells were shaken on orbital shaker for 1 hr at 37° C. The cells were washed twice with RPMI. Cells were resuspended at $2\times10^6$/mL in a 24 well flat bottom plate in 2 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)) and cultured for 48 hrs at 37° C., 5% $CO_2$. Cells were harvested, washed once in warm complete media at 1000 rpm for 10 minutes at room temperature. The cell pellet was resuspended in 500 µL of fresh media containing 1.5 µL of Senescence Dye per tube. Then, the cells were further incubated for 1-2 hr at 37° C., 5% $CO_2$ and washed 2× with 500 µL Wash buffer. Cell pellet was resuspended in 500 µL of wash buffer and was analyzed immediately by flow cytometry (Celesta-BD Bioscience).

As shown in FIG. 197, the percentages of senescence-associated n-gar cells decreased 7 days following the second dose of TGFRt15-TGFRs. These results demonstrate that TGFRt15-TGFRs can reduce the senescence-associated β-gal in tissues of aged mice.

Example 83: Senescence Markers CD26, IL-1α, p16INK4 and p21$^{CIP1}$ in Kidney, Skin, Liver and Lung Tissues The mouse kidney, skin, liver and lungs were harvested in order to evaluate the senescence markers CD26, IL-1α, p16 and p21 by quantitative PCR in tissues after treatment with TGFRt15-TGFRs or the PBS control group. C57BL/6, 76-week-old aged mice were purchased from The Jackson Laboratory. Mice were housed in a temperature and light controlled environment for one week before performing any study. Mice were divided into two groups as follows: PBS control group (n=6) and TGFRt15-TGFRs group (n=6). Mice were treated subcutaneously either with PBS or with TGFRt15-TGFRs at a dosage of 3 mg/kg on Day 0 and Day 10. On Day 7 following the second dose of study treatment, mice were euthanized and the kidney, skin, liver and lung were harvested and stored in liquid nitrogen in 1.7 mL Eppendorf tubes. Samples were homogenized by using mortar and pestle in liquid nitrogen. Homogenized tissues were transferred in fresh Eppendorf tubes containing 1 mL of Trizol (Thermo Fischer). Total RNA was extracted using RNeasy Mini Kit (Qiagen #74106) according to the manufacturer's instructions and 1 µg of total RNA was used for cDNA synthesis using the QuantiTect Reverse Transcription Kit (Qiagen). Real-time PCR was carried out with CFX96 Detection System (Bio-Rad) using FAM labeled predesigned primers purchased from Thermo Scientific. Reactions were run in triplicate for all the genes examined. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct=Ct_{target}-Ct_{18S}$.

As shown in FIGS. 198-201, there was no difference in senescence markers CD26 and IL-1α, however p21$^{CIP1}$ showed decreased expression in the liver (FIG. 198), lung (FIG. 201) and skin (FIG. 200) of TGFRt15-TGFRs-treated-mice. In the kidney (FIG. 199), both p21$^{CIP1}$ and IL1α markers were significantly decreased in the aged mice 7 days after the second dose of TGFRt15-TGFRs.

Example 84: β-Gal Staining on Kidney Tissues by Histology

The mouse kidney was prepared in order to evaluate senescence marker β-gal in kidney tissues after treatment with TGFRt15-TGFRs. C57BL/6, 76-week-old aged mice were purchased from The Jackson Laboratory. Mice were housed in a temperature and light controlled environment. Mice were divided into two groups as follows: PBS control group (n=6) and TGFRt15-TGFRs group (n=6). Mice were treated subcutaneously with either PBS or with TGFRt15-TGFRs at a dosage of 3 mg/kg on Day 0 and Day 10. On Day 7 following the second dose of study treatment, mice were euthanized and the kidneys were harvested, and half of the kidney tissue was embedded in tissue-tek cyromolds contain OCT compound. Tissue-tek cyromolds containing tissue were immediately frozen down in the vapor phase of liquid nitrogen. Samples were further processed to cut 4-8 urn thick cryostat sections (Lecia Cm 1800 Cryostat) and mounted on superfrost plus slides. Slides with sections were processed for senescence b-galactosidase staining kit (Cell Signaling) as per manufacturer's protocol. Tissue sections were observed under microscope.

As shown in FIG. 202, decreased numbers of senescence-associated β-gal$^+$ cells were observed in TGFRt15-TGFRs treated mice compared to control mice (n=3). These results demonstrate that TGFRt15-TGFRs treatment is able to reduce senescence-associated β-gal in tissues of aged mice.

Example 85: TGFRt15*-TGFRs Fusion Protein Generation

A fusion protein complex was generated comprising of TGFR/IL15RαSu and TGFR/TF/IL-15D8N fusion proteins (FIGS. 209 and 210). The human TGF-β receptor (TGFR), IL-15 alpha receptor sushi domain (IL15RaSu), tissue factor (TF) and IL-15 with D8N mutant (IL15D8N) sequences were obtained from the GenBank website and DNA fragments for these sequences were synthesized by Genewiz. Specifically, a construct was made linking the TGFR sequence to the N-terminus coding region of IL15RaSu and the TGFR sequence to the N-terminus of tissue factor 219 followed by the N-terminus coding region of IL-15D8N.

The nucleic acid sequence of the TGFR/IL15RaSu construct (including signal peptide sequence) is as follows:

```
(Signal peptide)
ATGAAGTGGGTGACCTTCATCAGCCTGCTGTTCCTGTTCTCCAGCGCCT
ACTCC (Single chain Human TGF-beta Receptor II homodimer)
ATCCCCCCCCATGTGCAAAAGAGCGTGAACAACGATATGATCGTGACCG
ACAACAACGGCGCCGTGAAGTTTCCCCAGCTCTGCAAGTTCTGCGATGT
CAGGTTCAGCACCTGCGATAATCAGAAGTCCTGCATGTCCAACTGCAGC
ATCACCTCCATCTGCGAGAAGCCCCAAGAAGTGTGCGTGGCCGTGTGGC
GGAAAAATGACGAGAACATCACCCTGGAGACCGTGTGTCACGACCCCAA
GCTCCCTTATCACGACTTCATTCTGGAGGACGCTGCCTCCCCCAAATGC
ATCATGAAGGAGAAGAAGAAGCCCGGAGAGACCTTCTTTTATGTGTTCCT
GTAGCAGCGACGAGTGTAACGACAACATCATCTTCAGCGAAGAGTACAA
CACCAGCAACCCTGATGGAGGTGGCGGATCCGGAGGTGGAGGTTCTGGT
```

-continued
```
GGAGGTGGGAGTATTCCTCCCCACGTGCAGAAGAGCGTGAATAATGACA
TGATCGTGACCGATAACAATGGCGCCGTGAAATTTCCCCAGCTGTGCAA
ATTCTGCGATGTGAGGTTTTCCACCTGCGACAACCAGAAGTCCTGTATG
AGCAACTGCTCCATCACCTCCATCTGTGAGAAGCCTCAGGAGGTGTGCG
TGGCTGTCTGGCGGAAGAATGACGAGAATATCACCCTGGAAACCGTCTG
CCACGATCCCAAGCTGCCCTACCACGATTTCATCCTGGAAGACGCCGCC
AGCCCTAAGTGCATCATGAAAGAGAAAAAGAAGCCTGGCGAGACCTTTT
TCATGTGCTCCTGCAGCAGCGACGAATGCAACGACAATATCATCTTTAG
CGAGGAATACAATACCAGCAACCCCGAC
```

(Sushi domain of IL15 receptor alpha chain)
```
ATTACATGCCCCCCTCCCATGAGCGTGGAGCACGCCGACATCTGGGTGA
AGAGCTATAGCCTCTACAGCCGGGAGAGGTATATCTGTAACAGCGGCTT
CAAGAGGAAGGCCGGCACCAGCAGCCTCACCGAGTGCGTGCTGAATAAG
GCTACCAACGTGGCTCACTGGACAACACCCTCTTTAAAGTGCATCCGG
```

The nucleic acid sequence of the TGFR/TF/IL15D8N construct (including signal peptide sequence) is as follows:

(Signal peptide)
```
ATGGGAGTGAAAGTTCTTTTTGCCCTTATTTGTATTGCTGTGGCCGAGG
CC
```

(Single chain Human TGF-beta Receptor II homodimer)
```
ATCCCACCGCACGTTCAGAAGTCGGTGAATAACGACATGATAGTCACTG
ACAACAACGGTGCAGTCAAGTTTCCACAACTGTGTAAATTTTGTGATGT
GAGATTTTCCACCTGTGACAACCAGAAATCCTGCATGAGCAACTGCAGC
ATCACCTCCATCTGTGAGAAGCCACAGGAAGTCTGTGTGGCTGTATGGA
GAAAGAATGACGAGAACATAACACTAGAGACAGTTTGCCATGACCCCAA
GCTCCCCTACCATGACTTTATTCTGGAAGATGCTGCTTCTCAAAGTGC
ATTATGAAGGAAAAAAAAAAGCCTGGTGAGACTTTCTTCATGTGTTCCT
GTAGCTCTGATGAGTGCAATGACAACATCATCTTTCTCAGAAGAATATAA
CACCAGCAATCCTGACGGAGGTGGCGGATCCGGAGGTGGAGGTTCTGGT
GGAGGTGGGAGTATTCCTCCCCACGTGCAGAAGAGCGTGAATAATGACA
TGATCGTGACCGATAACAATGGCGCCGTGAAATTTCCCCAGCTGTGCAA
ATTCTGCGATGTGAGGTTTTCCACCTGCGACAACCAGAAGTCCTGTATG
AGCAACTGCTCCATCACCTCCATCTGTGAGAAGCCTCAGGAGGTGTGCG
TGGCTGTCTGGCGGAAGAATGACGAGAATATCACCCTGGAAACCGTCTG
CCACGATCCCAAGCTGCCCTACCACGATTTCATCCTGGAAGACGCCGCC
AGCCCTAAGTGCATCATGAAAGAGAAAAAGAAGCCTGGCGAGACCTTTT
TCATGTGCTCCTGCAGCAGCGACGAATGCAACGACAATATCATCTTTAG
CGAGGAATACAATACCAGCAACCCCGAC
```

(Human Tissue Factor 219)
```
TCAGGCACTACAAATACTGTGGCAGCATATAATTTAACTTGGAAATCAA
CTAATTTCAAGACAATTTTGGAGTGGGAACCCAAACCCGTCAATCAAGT
CTACACTGTTCAAATAAGCACTAAGTCAGGAGATTGGAAAAGCAAATGC
TTTTACACAACAGACACAGAGTGTGACCTCACCGACGAGATTGTGAAGG
ATGTGAAGCAGACGTACTTGGCACGGGTCTTCTCCTACCCGGCAGGGAA
TGTGGAGAGCACCGGTTCTGCTGGGGAGCCTCTGTATGAGAACTCCCCA
GAGTTCACACCTTACCTGGAGACAAACCTCGGACAGCCAACAATTCAGA
GTTTTGAACAGGTGGGAACAAAAGTGAATGTGACCGTAGAAGATGAACG
GACTTTAGTCAGAAGGAACAACACTTTCCTAAGCCTCCGGGATGTTTTT
GGCAAGGACTTAATTTATACACTTTATTATTGGAAATCTTCAAGTTCAG
GAAAGAAAACAGCCAAACAAACACTAATGAGTTTTTGATTGATGTGGA
TAAAGGAGAAAACTACTGTTTCAGTGTTCAAGCAGTGATTCCCTCCCGA
ACAGTTAACCGGAAGAGTACAGACAGCCCGGTAGAGTGTATGGGCCAGG
AGAAAGGGGAATTCAGAGAA
```

(Human IL-15D8N)
```
AACTGGGTGAATGTAATAAGTAATTTGAAAAAAATTGAAGATCTTATTC
AATCTATGCATATTGATGCTACTTTATATACGGAAAGTGATGTTCACCC
CAGTTGCAAAGTAACAGCAATGAAGTGCTTTCTCTTGGAGTTACAAGTT
ATTTCACTTGAGTCCGGAGATGCAAGTATTCATGATACAGTAGAAAATC
TGATCATCCTAGCAAACAACAGTTTGTCTTCTAATGGGAATGTAACAGA
ATCTGGATGCAAAGAATGTGAGGAACTGGAGGAAAAAAATATTAAAGAA
TTTTTGCAGAGTTTTGTACATATTGTCCAAATGTTCATCAACACTTCT
```

The amino acid sequence of TGFR/IL15RaSu fusion protein (including signal peptide sequence) is as follows:

(Signal peptide)
MKWVTFISLLFLFSSAYS (Single chain Human TGF-beta Receptor II homodimer)
IPPHVQKSVNNDMIVTDNNGAVKFPQLCKFCDVRFSTCDNQKSCMSNCS
ITSICEKPQEVCVAVWRKNDENITLETVCHDPKLPYHDFILEDAASPKC
IMKEKKKPGETFFMCSCSSDECNDNIIFSEEYNTSNPDGGGGSGGGGSG
GGGSIPPHVQKSVNNDMIVTDNNGAVKFPQLCKFCDVRFSTCDNQKSCM
SNCSITSICEKPQEVCVAVWRKNDENITLETVCHDPKLPYHDFILEDAA
SPKCIMKEKKKPGETFFMCSCSSDECNDNIIFSEEYNTSNPD (Human IL-15 receptor α sushi domain)
ITCPPPMSVEHADIWVKSYSLYSRERYICNSGFKRKAGTSSLTECVLNK
ATNVAHWTTPSLKCIR The amino acid sequence of TGFR/TF/IL15D8N fusion protein (including signal peptide sequence) is as follows:

(Signal peptide)
MGVKVLFALICIAVAEA (Single chain Human TGF-beta Receptor II homodimer)
IPPHVQKSVNNDMIVTDNNGAVKFPQLCKFCDVRFSTCDNQKSCMSNCS
ITSICEKPQEVCVAVWRKNDENITLETVCHDPKLPYHDFILEDAASPKC
IMKEKKKPGETFFMCSCSSDECNDNIIFSEEYNTSNPDGGGGSGGGGSG
GGGSIPPHVQKSVNNDMIVTDNNGAVKFPQLCKFCDVRFSTCDNQKSCM
SNCSITSICEKPQEVCVAVWRKNDENITLETVCHDPKLPYHDFILEDAA
SPKCIMKEKKKPGETFFMCSCSSDECNDNIIFSEEYNTSNPD (Tissue factor)
SGTTNTVAAYNLTWKSTNFKTILEWEPKPVNQVYTVQISTKSGDWKSKC
FYTTDTECDLTDEIVKDVKQTYLARVFSYPAGNVESTGSAGEPLYENSP
EFTPYLETNLGQPTIQSFEQVGTKVNVTVEDERTLVRRNNTFLSLRDVF
GKDLIYTLYYWKSSSSGKKTAKTNTNEFLIDVDKGENYCFSVQAVIPSR
TVNRKSTDSPVECMGQEKGEFRE (IL-15D8N)
NWVNVISNLKKIEDLIQSMHIDATLYTESDVHPSCKVTAMKCFLLELQV
ISLESGDASIHDTVENLIILANNSLSSNGNVTESGCKECEELEEKNIKE
FLQSFVHIVQMFINTS The TGFR/IL15RαSu and TGFR/TF/IL-15D8N constructs were cloned into a modified retrovirus expression vectors as described previously (Hughes M S, Yu Y Y, Dudley M E, Zheng Z, Robbins P F, Li Y, et al). The expression vectors were transfected into CHO-K1 cells. Co-expression of the two constructs in CHO-K1 cells allowed for formation and secretion of the soluble TGFR/IL15RαSu-TGFR/TF/IL-15D8N protein complex (referred to as TGFRt15*-TGFRs), which can be purified by anti-TF antibody affinity.

Example 86: Binding Activity of TGFRt15-TGFRs and TGFRt15*-TGFRs to TGF-β1 and LAP Binding activity of TGFRt15-TGFRs to TGF-β1 and LAP was determined by ELISA. TGFRt15-TGFRs (5 mg/mL) was used to capture the titrated TGF-β1 (labeled as TGFβ1, BioLegend) and latent associated peptide of TGF-β1 (LAP, R&D Systems). TGF-β1 was detected by biotinylated anti-TGF-β1 (0.2 mg/mL, R&D Systems) and LAP by biotinylated anti-LAP (0.2 mg/mL, R&D Systems) followed by peroxidase conjugated streptavidin (Jackson ImmunoResearch Lab). 2,2'-azino-bis β-ethylbenzothiazoline-6-sulphonic acid) (ABTS, Surmodics IVD) was used as a substrate and measured by a plate reader. As shown in FIG. 211A, the results demonstrate that TGFRt15-TGFRs binds to TGF-β1 and LAP similarly, and more strongly than the Fc fusion.

Binding activity of TGF-β1 receptor/Fc fusion to TGF-β1 and LAP was determined by ELISA. A commercial TGF-β1 receptor II-Fc fusion (TGFRII/Fc) was used to compare the binding activity of TGFRt15-TGFRs to TGF-β1 and LAP. TGFRII/Fc (5 mg/mL, R&D Systems) was used to capture the titrated TGF-β1 and LAP. Other procedures were the same as described above. As shown in FIG. 211B, the results demonstrate that TGFRII/Fc binds to TGF-β1 and LAP similarly and its binding is comparable with TGFRt15-TGFRs, and stronger than the Fc fusion.

Binding Activity of TGFRt15-TGFRs and TGFRt15*-TGFRs to TGF-β1 and LAP

TGFRt15-TGFRs and TGFRt15*-TGFRs (10 mg/mL) were used to capture the titrated TGF-β1 LAP. Other procedures were the same as described above. As shown in FIGS. 211C and D, the results demonstrate that TGFRt15*-TGFRs binds to TGF-β1 and LAP similarly and its binding is comparable with TGFRt15-TGFRs, and stronger than the Fc fusion.

Binding of TGFRt15-TGFRs and TGFRt15*-TGFRs to CTLL-2 Cells

IL-2-dependent CTLL-2 cells were stained with TGFRt15-TGFRs (50 nM), TGFRt15*-TGFRs (50 nM), 7t15-21s (50 nM, IL-7-TF-IL15 and IL-21-IL-15RaSu) (as a control fusion molecule, which does not contains TGF-β1 receptor II), and PBS (as a negative control) for 60 minutes and probed by biotinylated second staining antibodies (Anti-TF: anti-human tissue factor, HCW Biologics and Anti-TGFR: anti-TGF-β receptor II: R&D Systems) and then followed by R-phycoerythrin-streptavidin (Jackson ImmunoResearch Lab). The mean fluorescent intensity (MFI) of staining was measured by flow cytometry. As shown in FIG. 211E, the results show that TGFRt15-TGFRs bound to CTLL-2 cells significantly better than other molecules, TGFRt15*-TGFRs less than TGFRt15-TGFRs because of the IL-15 mutant. However, 7t15-21s binding to CTLL-2 cells could be detected with anti-TF but not anti-TGFR.

Example 87: Biological Activities of TGFRt15-TGFRs and TGFRt15*-TGFRs with Cell-Based Assays TGF-β1 Blocking Activities of TGFRt15-TGFRs and TGFRt15*-TGFRs.

HEK-Blue TGF-β cells (InvivoGen) were incubated in IMDM-10 with titrated TGFRt15-TGFRs, TGFRt15*-TGFRs and TGFRII/Fc as a control in the presence of TGF-β1 (0.1 nM, BioLegend). TGFRII/Fc is a commercial TGF-β1 receptor II-Fc fusion (R&D Systems). After 24 hours of incubation, the culture supernatants were mixed with QUANTI-Blue (InvivoGen) and incubated for 1-3 hrs. The OD620 values were measured by a plate reader. As shown in FIG. 212A, TGFRt15-TGFRs and TGFRt15*-TGFRs had the same TGF-β1 blocking activity. In contrast, TGFRII/Fc (IC50=470.2 pM) had about 10 fold lower TGF-β1 blocking activity than TGFRt15-TGFRs (IC50=43.2 pM) or TGFRt15*-TGFRs (45.2 pM). The blocking activity was calculated with GraphPad Prism 7.04.

IL-15 Activity of TGFRt15-TGFRs and TGFRt15*-TGFRs

IL-15 dependent 32Dβ cells were cultured in IMDM-10 with titrated TGFRt15-TGFRs, TGFRt15*-TGFRs and IL15 as a control. WST-1 (Fisher Scientific) was added 2 days later and the OD450 values were measured by a plate reader. As shown in FIG. 212B, TGFRt15-TGFRs (EC50=1641 pM) had about 20 fold lower IL-15 biological activity than IL-15 itself (IC50=81.8 pM). As expected, TGFRt15*-TGFRs had no detectable IL-15 activity. The IL-15 activity was calculated with GraphPad Prism 7.04.

Reversal of TGF-6 Growth Suppression of CTLL-2 by TGFRt15*-TGFRs

TGF-β includes three isoforms (TGF-β1, TGF-β2 and TGF-β3). which have similar biological functions. CTLL-2 cells were used to compare biological blocking activity of TGFRt15*-TGFRs in this study. TGFRt15*-TGFRs is structurally very similar to TGFRt15-TGFRs, which cannot be used to do so due to the IL-15 activity of TGFRt15-TGFRs. CTLL-2 cells were cultured in RPMI-10 with titrated mouse IL-4 (Biolegend), TGF-β (5 ng/ml, TGF-β1 (Biolegend), TGF-β2, β3 (R&D Systems)) and TGFRt15*-TGFRs (21 nM; TGFRt15*-TGFRs:TGF-β molar ratio=100:1) for 5 days. Cell proliferation ($OD_{570-600}$ value) was determined by a plate reader after adding PrestoBlue (Fisher Scientific) at the last day culture. FIG. 212C shows that all three TGF-β similarly inhibited IL-4 induced CTLL-2 growth in the absence of TGFRt15*-TGFRs. FIG. 212D shows that TGFRt15*-TGFRs (21 nM; TGF-β:TGFRt15*-TGFRs molar ratio=1:100) significantly reversed the inhibition of TGF-β1 and TGF-β3 of IL-4-induced CTLL-2 cell growth, In contrast, TGFRt15*-TGFRs had minimum reversal TGF-β2 inhibitory activity.

Example 88: Stability of TGFRt15-TGFRs

Stability of TGFRt15-TGFRs by ELISA. TGFRt15-TGFRs was preincubated in RPMI medium with 50% human serum at 4° C., room temperature (RT) or 37° C. for 10 days. IL-15 domain and TGFβRII domain of TGFRt15-TGFRs were evaluated by ELISA. Anti-TF antibody (HCW Biologics) was used to capture TGFRt15-TGFRs molecules and biotinylated anti-IL-15 (R&D Systems) was used to detect IL-15 domain and biotinylated anti-TGFβRII (R&D Systems) was used to detect TGFβRII domain. Biotinylated detection antibodies were probed by peroxidase-streptavidin (Jackson ImmunoResearch Lab). 2,2'-azino-bis(3-ethylbenzothiazoline-6-sulphonic acid) (ABTS, Surmodics IVD) was used as a substrate and OD405 value was measured by a plate reader. As shown in FIGS. 213A and B, the results show that there were no significant changes in the domains of TGFRt15-TGFRs following 10 day incubation 4° C., RT, or 37° C. These findings demonstrate that IL-15 domain and TGFβRII domain of TGFRt15-TGFRs remain intact when incubated with human serum under the evaluated conditions.

Stability of TGFRt15-TGFRs Biological Activities with Cell-Based Assays

TGFRt15-TGFRs was preincubated in RPMI-10 with 50% human serum at 4° C., room temperature (RT) or 37° C. for 10 days. TGF-β1 neutralizing activity of TGFRt15-TGFRs was accessed with HEK-Blue TGF-β cells (TGF-β1 activity report cell line, InvivoGen). HEK-Blue TGF-β cells were incubated in IMDM-10 with titrated TGFRt15-TGFRs in the presence of TGF-β1 (0.1 nM). After 24 hours of incubation, the culture supernatants were mixed with QUANTI-Blue (InvivoGen) and incubated for 1-3 hrs. The OD620 values were measured by a plate reader. As shown in FIG. 213C, the results show that there were no changes in the TGF-β1 neutralizing activity of TGFRt15-TGFRs following incubation in human serum for 10 days at 4° C., RT, or 37° C. IL-15 activity of TGFRt15-TGFRs was evaluated with IL-15 dependent 32DP cells. 32Dβ cells were cultured in IMDM-10 with titrated TGFRt15-TGFRs. WST-1 (InvitroGen) was added 2 days later and the OD450 values were measured by a plate reader. As shown in FIG. 213D, the results show that there were no changes in the IL-15 activity of TGFRt15-TGFRs following incubation in human serum for 10 days at 4° C., RT, or 37° C.

Example 89: Reversal of TGF-β1 Immunosuppression for Human NK Cells and PBMC by TGFRt15-TGFRs and TGFRt15*-TGFRs Human NK cells were purified from blood buffy coats (4 donors, One Blood) with RosetteSep™ Human NK Cell Enrichment Cocktail (StemCell) according to StemCell instruction and PBMCs were isolated from blood buffy coats (6 donors) with Ficoll-Paque (Sigma-Aldrich) density centrifugation. NK cells and PBMCs were cultured in RPMI-10 with IL-15 (10 ng/mL, PeproTech) and/or TGF-β1 (10 ng/mL, Biolegend), TGFRt15-TGFRs (42 nM or 4.2 nM) or TGFRt15*-TGFRs (42 nM or 4.2 nM) for 3 days. The cultures were harvested and used for the following assays: cell mediated cytotoxicity assay (FIGS. 214A and B) and flow cytometry analyses for intracellular granzyme B (FIGS. 214C and D) and Interferon gamma (IFNγ, FIGS. 214E and F).

Cultured NK cells and PBMCs were used as effector cells and K562 tumor cells (ATCC) as target cells in cell mediated cytotoxicity assay. The mixtures of the effector cells and K562 tumor cells were incubated in RPMI-10 at 37° C. for 4 hours at E:T ratio=4:1 for NK cells (FIG. 214A) or 20:1 for PBMCs (FIG. 214B). The levels of dead K562 cells were determined by flow cytometry. As shown in FIGS. 214A and B, the results showed that there were significantly less dead K562 target cells in the presence of TGF-β1 than were observed medium control cultures, indicating that TGF-β1 inhibits immune cell cytotoxicity. However, there were significantly more dead K562 target cells in the presence of TGF-β1 and TGFRt15-TGFRs or TGFRt15*-TGFRs than was observed cultures incubated with TGF-β1 alone conditions. These findings demonstrate TGFRt15-TGFRs and TGFRt15*-TGFRs significantly reduced TGF-β1 immunosuppression and enhanced the cytotoxicity of human NK cells and PBMCs against K562 target cells in a concentration dependent manner. Additionally, the IL-15 activity of TGFRt15-TGFRs further enhances cytotoxicity of human NK cells and PBMCs when compared to the activity of TGFRt15*-TGFRs.

Cultured NK cells and PBMCs were stained with fluorochrome labeled anti-CD56 and anti-CD16 human NK cell surface markers and then with fluorochrome-labeled granzyme B and IFNγ intracellular molecules (BioLegend). The granzyme B and IFNγ expression (MFI: mean fluorescence intensity) in the purified NK cells and gated NK cells (CD56$^+$ and/or CD16$^+$) of PBMC cultures were analyzed by flow cytometry. As shown in FIGS. 214C and D, there was significantly less granzyme B (FIGS. 214C and 214D) and IFNγ (FIGS. 214E and 214F) expression in NK cells cultured in the presence of TGF-β1 than was observed in cells cultured in medium alone, indicating that TGF-β1 inhibits immune cell activation. However, there was significantly higher granzyme B and IFNγ expression NK cells cultures in the presence of TGF-β1 and TGFRt15-TGFRs or TGFRt15*-TGFRs than was observed in cells cultured in TGF-β1 alone. The TGFRt15*-TGFRs had a minimum effect on granzyme B and IFNγ expression at 4.2 nM concentration. These findings demonstrate TGFRt15-TGFRs and TGFRt15*-TGFRs significantly enhanced the granzyme B and IFNγ expression of human NK cells in a concentration-dependent manner through the activities of the IL-15 and TGFβRII domains.

Example 90: Half-Life of TGFRt15-TGFRs in C57BL/6 Mice

The pharmacokinetics (half-life, t½) of TGFRt15-TGFRs was evaluated in female C57BL/6 mice. The mice were treated subcutaneously with TGFRt15-TGFRs at a dosage of 3 mg/kg. The mouse blood was collected from tail vein at various time points and the serum was prepared. The TGFRt15-TGFRs concentrations in mouse serum was determined with ELISA. Anti-TF antibody (anti-human tissue factor antibody generated in HCW Biologics) was used to capture TGFRt15-TGFRs molecules and biotinylated anti-TGFβRII (R&D Systems) was used to detect TGFβRII domain. Biotinylated detection antibodies were probed by peroxidase-streptavidin (Jackson ImmunoResearch Lab). 2,2'-azino-bis(3-ethylbenzothiazoline-6-sulphonic acid) (ABTS, Surmodics IVD) was used as a substrate and the OD405 values were measured by a plate reader. As shown in FIG. 215, the half-life of TGFRt15-TGFRs was 18.22 hours in C57BL/6 mice calculated with GraphPad Prism 7.04.

Example 91: Toxicity of TGFRt15-TGFRs in C57BL/6 Mice

A single dose of TGFRt15-TGFRs (50-400 mg/kg) was subcutaneously injected into C57BL/6 female mice (7 weeks old, n=4). Mouse bodyweight was measured as shown in FIG. 216 and clinical signs (mortality, morbidity, ruffled fur, hunched posture, lethargy, etc.) were assessed during experimental period. The mice that received 200 mg/kg or 400 mg/kg of TGFRt15-TGFRs showed less activity 6-8 days post-treatment and without other significant clinical signs. TGFRt15-TGFRs at 200 mg/kg or 400 mg/kg caused loss in mouse body weight compared with PBS group especially on day 7 after treatment (p<0.05). The affected mice gradually recovered after 10 days without mortality or morbidity. As shown in FIG. 216, these findings indicate that C57BL/6 mice can tolerate single dose TGFRt15-TGFRs at up to 100 mg/kg.

Example 92: Antitumor Activity of TGFRt15-TGFRs in a C57BL/6 Murine Melanoma Model Mouse B16F10 melanoma cells were subcutaneously injected into C57BL/6 mice (The Jackson Laboratory) to establish the mouse melanoma model. Four days after tumor cell injection, the mice were divided into different groups to receive the following immunotherapies: Group 1: PBS vehicle control; Group 2: antitumor antibody TA99 (10 mg/kg) alone control; Group 3: TA99 combined with IL-15SA (0.05 mg/kg); Group 4: TA99 combined with TGFRt15-TGFRs (4.93 mg/kg, equivalent IL-15 activity of 0.05 mg/kg IL-15SA); and Group 5: TA99 combined with TGFRt15*-TGFRs (4.93 mg/kg. IL-15D8N mutant without IL-15 activity). The tumor volume was measured and calculated using the formula: length×width×width/2 formula. As shown in FIG. 217, the results indicated that the mice receiving antitumor antibody TA99 combined with TGFRt15-TGFRs or IL15SA had significantly smaller tumors at day 11 after tumor inoculation, when compared to the PBS, TA99 antibody alone, and TA99 with TGFRt15*-TGFRs groups (p<0.05). There was no significant difference among groups 1, 2, and 5 and between groups 3 and 4. These findings demonstrated that IL-15 activity of TGFRt15-TGFRs was important for antitumor activity of TGFRt15-TGFRs.

Example 93: Model of Lung Fibrosis—Treatment with TGFRt15-TGFRs

Inflammatory and fibrotic lung diseases (including idiopathic pulmonary fibrosis, chronic obstructive pulmonary disease and cystic fibrosis) are major causes of death with limited treatment options. Additionally, various therapies result in lung injury side effects leading to pulmonary fibrosis. For example, lung toxicity develops in ~10% of cancer patients receiving bleomycin chemotherapy. These effects have led to the use of bleomycin treatment in rodents to model pulmonary fibrosis for the study of mechanisms involved in fibrogenesis and for evaluation of potential therapies. To assess the activity of TGFRt15-TGFRs in this model, nine-week old C57B16/j male mice were given 50 µL of bleomycin (2.5 mg/kg, single dose) through the oropharyngeal route. Mice were given TGFRt15-TGFRs subcutaneously (3 mg/kg) on day 17 following bleomycin treatment. Mice were sacrificed on day 28 post-bleomycin. Lungs were isolated and left lung was homogenized and 100 µL of homogenate was assayed for hydroxyproline content as a measure of collagen deposition using commercially available kit according to manufacturer's instructions. The data was expressed as fig of hydroxyproline content per gram of lung. As shown in FIG. 218, the results indicate that TGFRt15-TGFRs therapy significantly reduced collagen deposition (i.e., fibrosis) in the lungs of bleomycin-treated mice.

Example 94: In Vivo Characterization of the Activities of TGFRt15-TGFRs and TGFRt15*-TGFRs It has been shown that protection from obesity and diabetes in leptin deficient ob/ob mice can be achieved by blockade of TGF-β/Smad3 signaling. To assess if TGFRt15-TGFRs or TGFRt15*-TGFRs can protect mice from obesity and diabetes by blockade of TGF-β/Smad3 signaling, the leptin receptor deficient db/db mouse strain (BKS.Cg Dock7m$^{+/+}$ Leprdb/J) was used for the study. Six-week-old db/db mice were divided to three groups (N=8 per group). Mice were injected subcutaneously with TGFRt15-TGFRs, TGFRt15*-TGFRs, or PBS at 3 mg/kg. Blood was collected at day 4 post-injection through the submandibular vein after the mice had been fasting for 20 hours. The fasting blood glucose was measured with OneTouch UltraMini meter immediately after blood was drawn. As shown in FIG. 219, both TGFRt15-TGFRs and TGFRt15*-TGFRs can reduce the fasting plasma glucose levels significantly.

The plasma TGFβ1-3 levels were assessed to identify the cause of treatment-related reduction of fasting plasma glucose in db/db mice. Four days after treatment, plasma was isolated and 30 µL of plasma was sent to EVE Technologies (Calgary, AB Canada) to assess TGFβ1-3 levels by the TGF-β 3-Plex (TGFB1-3) assay. As shown in FIGS. 220A-C, both TGFRt15-TGFRs and TGFRt15*-TGFRs completely depleted plasma TGFβ1 (FIG. 220A), partially reduced TGFβ2 (FIG. 220B), and had no effect on TGFβ3 (FIG. 220C).

The lymphocyte subsets were assessed to identify the cause of treatment-related reduction of fasting plasma glucose in db/db mice. Four days after treatment, whole blood cells (50 µl) were treated with ACK (Ammonium-Chloride-Potassium) lysing buffer to lyse red blood cells. The lymphocytes were then stained with PE-Cy7-anti-CD3, BV605-anti-CD45, PerCP-Cy5.5-anti-CD8a, BV510-anti-CD4, and APC-anti-NKp46 (all antibodies from BioLegend) to assess the populations of T cells and NK cells. The cells were further permeabilized and fixed with eBioscience Foxp3/Transcription factor staining buffer set (Cat #00-5523-00, ThermoFisher) and stained with AF700-anti-Ki67 and FITC-anti-Granzyme B in eBioscience Permeabilization buffer (Cat #00-8333-56, ThermoFisher) to assess the proliferation and activation of T cells and NK cells. Another set of lymphocytes were stained with PE-Cy7-anti-CD3, BV605-anti-CD45, BV510-anti-CD4 and apc-Cy7-anti-CD25 first, and then permeabilized and fixed with eBioscience Foxp3/Transcription factor staining buffer set (Cat #00-5523-00, ThermoFisher) and stained with PE-anti-Foxp3 in eBioscience Permeabilization buffer (Cat #00-8333-56, ThermoFisher) to assess the population of Treg cells.

TGFRt15-TGFRs increased the population of NK cells (FIG. 221A) and CD8$^+$ T cells (FIG. 221D), stimulated the proliferation of NK cells (FIG. 221B) and CD8$^+$ T cells (FIG. 221E), and activated NK cells (FIG. 221C). TGFRt15*-TGFRs had no effect on either cell population (FIG. 221A-E). Both TGFRt15-TGFRs and TGFRt15*-TGFRs had no effect on CD4$^+$ T cells, CD19$^+$ B cells, and CD4$^+$CD25$^+$Foxp3$^+$ Treg cells.

In conclusion, in db/db mice, both TGFRt15-TGFRs and TGFRt15*-TGFRs reduced fasting plasma glucose levels and both TGFRt15-TGFRs and TGFRt15*-TGFRs completely depleted plasma TGFβ1. However, only TGFRt15-TGFRs activated NK cells and enhanced CD8$^+$ T cells and NK cells proliferation. Based on these results, the depletion of TGFβ1 likely was involved in the reduction of fasting plasma glucose, showing that blockade of TGF-β/Smad3 signaling played a role in prevention of obesity and diabetes in ob/ob mice.

Example 95: In Vitro Characterization of the Activities of TGFRt15-TGFRs and TGFRt15*-TGFRs TGFRII was demonstrated to interact with TGFβ1-3. There is no report in the literature demonstrating interactions between TGFRII and latent TGFβ. To assess whether TGFRt15-TGFRs, TGFRt15*-TGFRs, and TGFRII-Fc interacts with latent TGFβ we applied 2.5 nM of human latent TGFβ1-his tag (Cat #TG1-H524x, Acro Biosystems) or a control protein CD39-his tag (Lot #58-49/51, HCW Biologics) in 50 mM carbonate buffer pH 9.4 (100 µl/well) to coat an ELISA plate (Cat #80040L E0910, ThermoFisher) overnight at 4° C. Next day, the plate was washed with ELISA washing buffer (phosphate-buffered saline with 0.05% Tween 20) three times, the plate was blocked with the blocking buffer (1% BSA-PBS) for 1 hour, and then descending concentrations of TGFRt15-TGFRs, TGFRt15*-TGFRs, or TGFRII-Fc from 200 nM to 0.09 nM in blocking buffer were added to the plate and the plate was incubated for 1 hour at 25° C. The plate was washed three times with ELISA washing buffer. A detection antibody, biotinylated anti-TGFRII antibody (Cat #BAF241, R&D Systems), at 0.1 µg/mL was added to the plate and incubated at 25° C. for 1 hour. The plate was washed and horseradish peroxidase-streptavidin (code #016-030-084, Jackson ImmunoResearch) at 0.25 µg/mL was added to the plate and incubated at 25° C. for 30 minutes. The plate was washed and a substrate of HRP, ABTS (Cat #ABTS-1000-01, Surmodics) was added to the plate and incubated for 20 minutes at 25° C. The plate was read with a microplate reader (Multiscan Sky, Thermo Scientific) at OD405 nm. As shown in FIG. 222A, both TGFRt15-TGFRs and TGFRt15*-TGFRs interacted with latent TGFβ1 similarly. However, TGFRII-Fc interacted with latent TGFβ1 with lower affinity than was seen with TGFRt15*-TGFRs (FIG. 222B). The results demonstrated TGFRt15-TGFRs, TGFRt15*-TGFRs, and TGFRII-Fc can interact with latent TGFβ1, with TGFRt15-

TGFRs, TGFRt15*-TGFRs surprisingly showing higher affinity interaction than TGFRII-Fc.

Example 96: Prothrombin Time Test

Prothrombin time (PT) test is designed to measure the time it takes for plasma to clot after mixing with tissue factor and an optimal concentration of calcium. Tissue factor mixture with phospholipids (called Thrombinplastin) acts as an enzyme to convert prothrombin to thrombin, which in turn causes blood clotting by converting fibrinogen to fibrin. Innovin is a lipidated recombinant human TF243 and is used as the standard in our experiment. In the PT assay, shorter PT time (clotting time) indicates a higher TF-dependent clotting activity while longer PT (clotting time) means lower TF-dependent clotting activity.

Briefly, 0.1 mL of normal human plasma (Ci-Trol Coagulation Control, Level I) was prewarmed at 37° C. for 3 minutes. Plasma clotting reactions were initiated by adding 0.2 mL of various dilutions of Innovin or testing sample (TGFRt15-TGFRs) diluted in PT assay buffer (50 mM Tris-HCl, pH 7.5, 14.6 mM $CaCl_2$), 0.1% BSA) to the plasma. Clotting time was monitored and reported by STart PT analyzer (Diagnostica Stago, Parsippany, NJ).

As seen in FIG. 223, different amounts of Innovin (Innovin reconstituted with purified water equivalent to 10 nM of lipidated recombinant human TF243 is considered to be 100% Innovin) added to the PT assay indeed demonstrated an inverse relationship between the amount of TF243 added in the PT assay and the PT time. For example, 1% Innovin had a PT time of about 25.0 seconds, while 100% Innovin had a PT time of 8.5 seconds.

FIG. 224 shows the result of the PT test on TGFRt15-TGFRs. In contrast to Innovin, TGFRt15-TGFRs exhibited prolonged PT times which were almost the same as buffer, indicating extremely low or no clotting activity.

The clotting effect of TGFRt15-TGFRs in the presence of CTLL cells was also evaluated. The binding experiment conducted confirmed that TGFRt15-TGFRs can bind to CTLL cells. The TGFRt15-TGFRs clotting test in the presence of CTLL cells will reflect more closely with the potent clotting activity in vivo. TGFRt15-TGFRs was preincubated with CTLL cells for 20-30 min at 37° C. in PT assay buffer. Then we proceeded with the PT assay as described above. FIG. 224 shows that mixture of TGFRt15-TGFRs with CTLL cells had a bit shorter clotting time (154.6 sec) than TGFRt15-TGFRs alone (167.6 sec) or CTLL cells alone (161.9 sec). However, the clotting time of 154.6 seconds is still significantly longer than the Innovin clotting time of 8.5 seconds.

In summary, TGFRt15-TGFRs has extremely low or no TF-dependent clotting activity (i.e., in the physiological ranges of coagulation factors in human plasma), even in the presence of cells capable of binding TGFRt15-TGFRs.

Example 97: Gene Expression of Senescence Markers in Tissues of Young Mice, and of Aged Mice Following Treatment with TGFRt15-TGFRs or PBS and Short-Term (10 Days) or Long-Term (60 Days) Follow-Up C57BL/6, 72-week-old mice were purchased from the Jackson Laboratory. Mice were housed in a temperature and light controlled environment. Mice were divided into two groups and treated subcutaneously with either PBS (PBS control group) or TGFRt15-TGFRs at a dosage of 3 mg/kg (TGFRt15-TGFRs group). Either at day 10 or day 60 post-treatment, mice were euthanized, and kidneys were harvested in order to evaluate the expression levels of senescence markers PAIL IL-1α, IL6, and TNFα by quantitative-PCR. Harvested kidneys were stored in liquid nitrogen in 1.7 mL Eppendorf tubes. Samples were homogenized by using homogenizer in 1 mL of Trizol (Thermo Fischer). Homogenized tissues were transferred in fresh Eppendorf tubes. Total RNA was extracted using RNeasy Mini Kit (Qiagen #74106) according to the manufacturer's instructions. One µg of total RNA was used for cDNA synthesis using the QuantiTect Reverse Transcription Kit (Qiagen). Real-time PCR was carried out with CFX96 Detection System (Bio-Rad) using FAM labeled predesigned primers purchased from Thermo Scientific. Reactions were run in triplicate for all the genes examined. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct = Ct_{target} - Ct_{18S}$. Untreated 6-week-old mice (Young) were used as a control to compare the gene expression level to aged mice.

As shown in FIG. 225, the results show that gene expression of PAI-1, IL-1α, IL6, and IL-1β in kidney increased with the age of the mice as expected with the age-dependent increase in cellular senescence. Treatment of 72-month old mice with a single dose of TGFRt15-TGFRs resulted in a significant and long-lasting effect in reducing gene expression of senescence markers in kidneys, suggesting a treatment associated decrease in naturally-occurring senescent cells in the kidneys of aged mice.

As shown in FIG. 226, the results showed that treatment of 72-month old mice with a single dose of TGFRt15-TGFRs mediated in a significant and long-lasting effect in reducing IL-1α and IL6 gene expression in liver, suggesting a treatment associated decrease in naturally-occurring senescent cells in the liver of aged mice.

C57BL/6, 72-week-old mice were purchased from the Jackson Laboratory. Mice were housed in a temperature and light controlled environment. Mice were divided into two groups and treated subcutaneously with either PBS (PBS control group) or TGFRt15-TGFRs at a dosage of 3 mg/kg (TGFRt15-TGFRs group). Either at day 10 or day 60 post-treatment, mice were euthanized, and kidneys were harvested in order to evaluate the proteins levels of the senescence marker PAI-1 by a tissue ELISA. Harvested kidneys were stored in liquid nitrogen in 1.7 mL Eppendorf tubes. Samples were homogenized by using homogenizer in 0.3 mL of extraction buffer (Abram).

Homogenized tissues were transferred in fresh Eppendorf tubes. Protein level in homogenized tissue was quantified using BCA Protein Assay Kit (Pierce). Mouse PAI-1 ELISA (R&D System) was performed with 200 mg of tissue homogenate. Based on a standard curve, the concentration of PAI-1 was calculated as picograms per milligram of tissue.

As shown in FIG. 227, the protein levels of senescence markers PAI-1 decreased in the kidneys of TGFRt15-TGFRs treated aged mice compared to PBS group at 60 days post-treatment. These results are consistent with the effects of TGFRt15-TGFRs treatment on the PAI-1 gene expression in the kidneys of aged mice. Together, these results indicate that a single treatment of TGFRt15-TGFRs resulted in a significant and long-lasting effect in reducing naturally-occurring senescent cells (as measured by reduced gene and protein expression of senescence markers) in the tissues of aged mice.

Example 98: Comparison of TGFRt15-TGFRs and TGFRt15*-TGFRs (IL-15 Mutant) Treatment in Reducing Gene Expression of Senescence Markers in Tissues of Aged Mice C57BL/6, 72-week-old mice were purchased from the Jackson Laboratory. Mice were housed in a temperature and light controlled environment. Mice were divided into five groups as follows: saline control group (n=8); TGFRt15-TGFRs group (n=8); IL15SA group (n=8); TGFRt15*-TGFRs group (n=8); and IL15SA+TGFRt15*-TGFRs group (n=8). Mice were treated subcutaneously with PBS, TGFRt15-TGFRs (3 mg/kg), TGFRt15*-TGFRs (3 mg/kg), IL15SA (0.5 mg/kg), or TGFRt15*-TGFRs (3 mg/kg) plus IL15SA (0.5 mg/kg). Mouse blood was prepared in order to evaluate changes in the different subsets of immune cells after treatment with TGFRt15-TGFRs and other agents. The mouse blood was collected from submandibular vein on Day 17 post-treatment in tubes containing EDTA. The whole blood was centrifuged to collect plasma at 3000 RPM for 10 minutes in a micro centrifuge. Plasma was stored at $-80°$ C. and whole blood was processed for immune cell phenotyping by flow cytometry. Whole blood RBCs were lysed in ACK buffer for 5 minutes at room temperature. Remaining cells were washed in FACS buffer (1×PBS (Hyclone) with 0.5% BSA (EMD Millipore) and 0.001% Sodium Azide (Sigma)). To assess the different types of immune cells in blood, cells were stained with antibodies specific to cell-surface CD3, CD45, CD8, and NK1.1 (BioLegend) for 30 minutes at room temperature (RT). After surface staining, cells were washed (1500 RPM for 5 minutes at room temperature) in FACS buffer (1×PBS (Hyclone) with 0.5% BSA (EMD Millipore) and 0.001% Sodium Azide (Sigma)). After two washes, cells were resuspended in fixation buffer and analyzed by flow cytometry (Celesta-BD Bioscience).

As shown in FIG. 228, the results indicate that treatment of aged mice with TGFRt15-TGFRs. IL15SA (positive control) or TGFRt15*-TGFRs+IL15SA mediated an increase in the percentages of $CD3^+CD8^+$, $CD3^-NK1.1^+$, and $CD3^+CD45^+$ immune cells in the blood, whereas treatment with TGFRt15*-TGFRs had little or no effect on the percentage of these cell populations. These results suggest that IL-15 activity of TGFRt15-TGFRs plays a role in increasing $CD8^+$ T cells and NK cells in the blood of aged mice.

As shown in FIG. 229, the results indicate that treatment of aged mice with TGFRt15-TGFRs. IL15SA (positive control) or TGFRt15*-TGFRs+IL15SA mediated an increase in the percentages of $CD3^+CD8^+$, $CD3^-NK1.1^+$, and $CD3^+CD45^+$ immune cells in the spleen, whereas treatment with TGFRt15*-TGFRs had little or no effect on the percentage of these cell populations. These results suggest that IL-15 activity of TGFRt15-TGFRs plays a role in increasing $CD8^+$ T cells and NK cells in the spleen of aged mice.

C57BL/6, 72-week-old mice were purchased from the Jackson Laboratory. Mice were housed in a temperature and light controlled environment. Mice were divided into five groups as follows: saline control group (n=8); TGFRt15-TGFRs group (n=8); IL15SA group (n=8); TGFRt15*-TGFRs group (n=8); and IL15SA with TGFRt15*-TGFRs group (n=8). Mice were treated subcutaneously with PBS, TGFRt15-TGFRs (3 mg/kg), TGFRt15*-TGFRs (3 mg/kg), IL15SA (0.5 mg/kg), or TGFRt15*-TGFRs (3 mg/kg) plus IL15SA (0.5 mg/kg). The mouse kidney, liver, and lungs were harvested in order to evaluate the gene expression of senescence markers p21, PAI1, IL-1α, and IL6 by quantitative-PCR in tissues after treatment with TGFRt15-TGFRs, TGFRt15*-TGFRs, or control groups. Mice were euthanized day 17 post-treatment and kidney, liver, and lung were harvested and stored in liquid nitrogen in 1.7 mL Eppendorf tubes. Samples were homogenized by using homogenizer in 1 mL of Trizol (Thermo Fischer). Homogenized tissues were transferred in fresh Eppendorf tubes. Total RNA was extracted using RNeasy Mini Kit (Qiagen #74106) according to the manufacturer's instructions. One pg of total RNA was used for cDNA synthesis using the QuantiTect Reverse Transcription Kit (Qiagen). Real-time PCR was carried out with CFX96 Detection System (Bio-Rad) using FAM labeled predesigned primers purchased from Thermo Scientific. Reactions were run in triplicate for all the genes examined. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct = Ct_{target} - Ct_{18S}$.

As shown in FIG. 230A-D, treatment of 72-month old mice with a single dose of TGFRt15-TGFRs or TGFRt15*-TGFRs mediated in a significant decrease in p21, PAI1, IL-1α, and IL6 gene expression in kidney and liver, suggesting a treatment associated decrease in naturally-occurring senescent cells in the kidney and liver of aged mice. The results of this study suggest that both the IL-15 and TGF-β trap activities of TGFRt15-TGFRs are capable of reducing naturally-occurring senescent cells in the tissues of aged mice.

Example 99: Immuno-Phenotype Following Treatment with IL-15-Based Agents

The mouse blood was prepared in order to evaluate changes in the different subsets of immune cells after treatment with IL-15-based agents: TGFRt15-TGFRs, an IL-15 superagonist (IL-15SA), and an IL-15 fusion with a D8N mutant knocking out the IL-15 activity (TGFRt15*-TGFRs). C57BL/6, 6-week-old mice were purchased from Jackson Laboratory. Mice were housed in a temperature and light controlled environment. Mice were divided into groups (n=6/group) and treated with the following: 1) PBS (saline) control, 2) docetaxel, 3) docetaxel with TGFRt15-TGFRs, 4) docetaxel with IL15SA, 5) docetaxel with an IL-15 mutant (TGFRt15*-TGFRs), and 6) docetaxel with an IL-15 superagonist (IL-15SA) plus TGFRt15*-TGFRs. Senescence was induced in mice with three doses of docetaxel (10 mg/kg) at day 1, 4, and 7. On day 8, the mice were treated subcutaneously with PBS, TGFRt15-TGFRs, TGFRt15*-TGFRs, IL-15SA or in combinations as discussed above. TGFRt15-TGFRs and TGFRt15*-TGFRs were administered at a dosage of 3 mg/kg and IL-15SA was administered at 0.05 mg/kg. The mouse blood was collected from the submandibular vein on day 3 post-study drug treatment into EDTA tubes. The whole blood was centrifuged to collect plasma at 3000 RPM for 10 minutes in a microcentrifuge. Plasma was stored at $-80°$ C. and whole blood was processed for immune cell phenotyping by flow cytometry. RBCs were lysed in ACK buffer for 5 minutes at 37° C. The remaining cells were washed in FACS buffer (1×PBS (Hyclone) with 0.5% BSA (EMD Millipore) and 0.001% Sodium Azide (Sigma)). To assess the different types of immune cells in the blood, cells were stained with antibodies for cell-surface CD4, CD45, CD19, CD8, and NK1.1 (BioLegend) for 30 minutes at room temperature (RT). After surface staining, cells were washed (1500 RPM for 5 minutes at room temperature) in FACS buffer (1×PBS (Hyclone)

with 0.5% BSA (EMD Millipore) and 0.001% Sodium Azide (Sigma)). The cells were treated with permeabilization buffer (Invitrogen) for 20 minutes at 40° C. followed by wash with permeabilization buffer (Invitrogen). The cells were then stained for an intracellular marker for proliferation (Ki67) for 30 minutes at RT. After two washes, the cells were resuspended in fixation buffer and analyzed by flow cytometry (Celesta-BD Bioscience).

As shown in FIGS. 231A and 231B, the results indicate that treatment of mice with TGFRt15-TGFRs, IL15SA (positive control), or TGFRt15*-TGFRs+IL15SA mediated an increase in the percentages and proliferation (as measured by Ki67) of $CD8^+$ T cells and $NK1.1^+$ cells in the blood, whereas treatment with TGFRt15*-TGFRs had little or no effect on the percentage of these cell populations. These results suggest that IL-15 activity of TGFRt15-TGFRs plays a role in increasing $CD8^+$ T cells and NK cells in the blood of mice following chemotherapy.

Example 100: Evaluation of Gene Expression of Senescence Markers p21 and CD26 in Lung and Liver Tissues of Mice Following Chemotherapy and Treatment with IL-15-Based Agents Gene expression of markers for cell senescence were evaluated in tissues of normal mice following chemotherapy and administration of study treatments. C57BL/6, 6-week-old mice were purchased from Jackson Laboratory. Mice were housed in a temperature and light controlled environment. Mice were divided into six groups and treated with the following: 1) PBS (saline) control (n=5), 2) docetaxel (n=8), 3) docetaxel with TGFRt15-TGFRs (n=8), 4) docetaxel with IL15SA (n=8), 5) docetaxel with an IL-15 mutant (TGFRt15*-TGFRs) (n=8), and 6) docetaxel with an IL-15 superagonist (IL-15SA) plus TGFRt15*-TGFRs (n=6). Senescence was induced in mice with three doses of docetaxel (10 mg/kg) at day 1, 4, and 7. On day 8, the mice were treated subcutaneously with PBS, TGFRt15-TGFRs, TGFRt15*-TGFRs, IL-15SA, or in combinations as discussed below. TGFRt15-TGFRs and TGFRt15*-TGFRs were administered at a dosage of 3 mg/kg and IL-15SA was administered at 0.5 mg/kg. The mouse tissues were prepared in order to evaluate the different gene expression of senescence markers. Mice were euthanized on day 7 post-study drug treatment and the liver and lung tissues were harvested and stored in liquid nitrogen in 1.7 mL Eppendorf tubes. Samples were homogenized by using mortar and pestle in liquid nitrogen. Homogenized tissues were transferred in fresh Eppendorf tubes containing 1 mL of Trizol (Thermo Fischer). Total RNA was extracted using RNeasy Mini Kit (Qiagen #74106) according to the manufacturer's instructions and 1 µg of total RNA was used for cDNA synthesis using the QuantiTect Reverse Transcription Kit (Qiagen). Real-time PCR was carried out with CFX96 Detection System (Bio-Rad) using FAM labeled predesigned primers purchased from Thermo Scientific. Reactions were run in triplicate for all the genes examined. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct = Ct_{target} - Ct_{18S}$.

Figure 232:
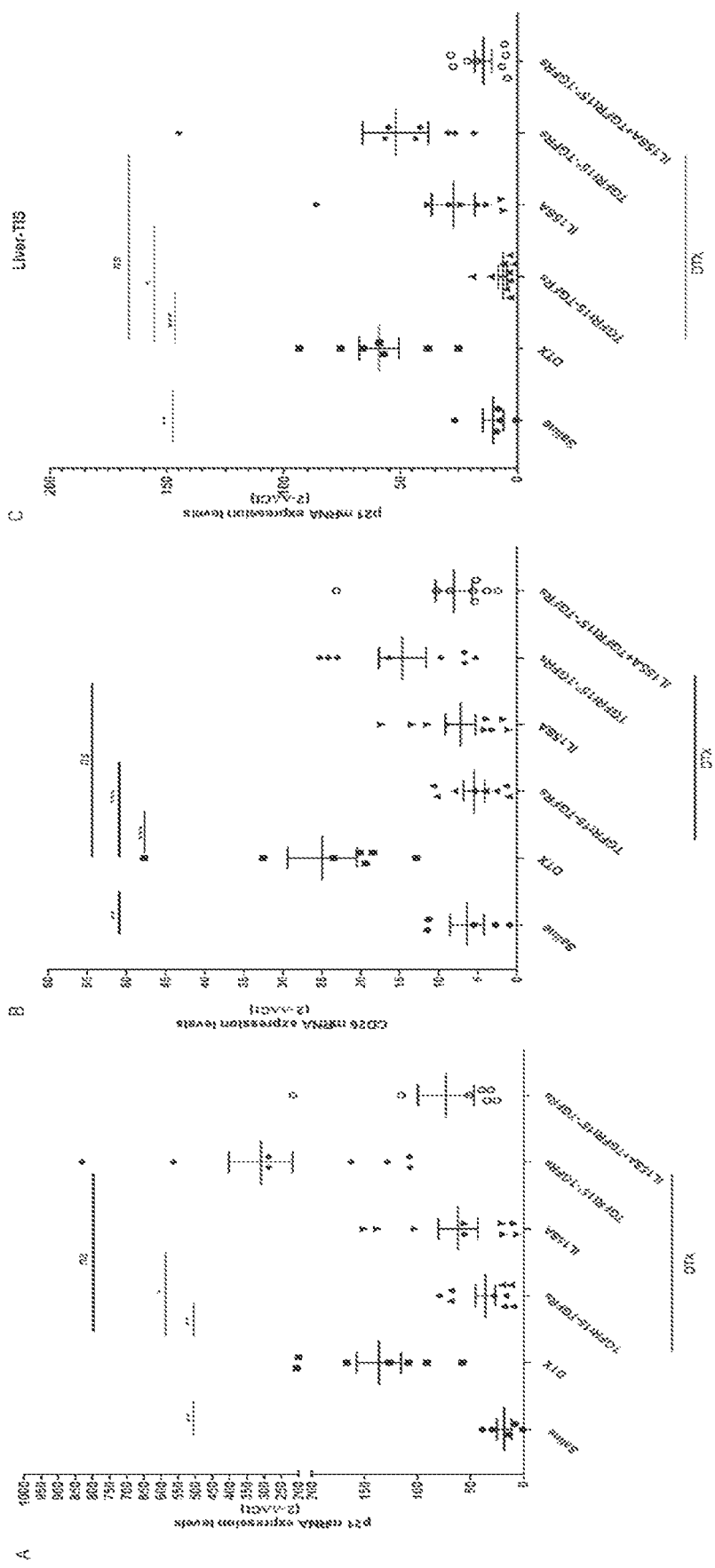

As shown in the FIG. 232, gene expression of the senescence markers p21 and CD26 was induced in the lung (FIG. 232A) and (FIG. 232B), and p21 in liver (FIG. 232C) tissues of mice treated with docetaxel, as compared to gene expression in tissue of saline-treated mice. Gene expression of senescence markers p21 and CD26 in the lungs and p21 in the liver were reduced of the chemotherapy-treated mice following subsequent treatment with TGFRt15-TGFRs, IL-15SA, and combination of IL-15SA and TGFRt15*-TGFRs mutant, as compared to the chemotherapy-treated controls. However, the TGFRt15*-TGFRs mutant treatment failed to effect the chemotherapy-induced senescence marker gene expression in these tissues. These results show that IL-15 activity is important for clearance of TIS senescence cells in normal tissues of mice.

Example 101: TGFRt15-TGFRs Treatment Enhances the Immune Cell Proliferation, Expansion, and Activation in the Peripheral Blood of B16F10 Tumor Bearing Mice C57BL/6 mice were subcutaneously injected with 0.5×$10^6$ B16F10 cells. After tumor inoculation (day 0), the mice were given three doses of doxetaxel chemotherapy (10 mg/kg) on days 1, 4, and 7 and single dose of TGFRt15-TGFRs (3 mg/kg) combined with monoclonal antibody targeting a tumor antigen anti-TYRP-1 antibody TA99 (200 µg) on day 8. Tumor-bearing mice treated with saline or doxetaxel chemotherapy (10 mg/kg) on days 1, 4, and 7 served as controls. Blood was drawn from submandibular vein on days 3, 5, and 10 after immunotherapy treatment (day 8). The RBCs were lysed in ACK lysis buffer and the lymphocytes were washed and stained with antibodies specific to cell-surface expression of NK, CD8, CD25, and Granzyme B (GzB) (BioLegend) for 30 minutes at room temperature (RT). After surface staining, the cells were washed (1500 RPM for 5 minutes at RT) in FACS buffer (1×PBS (Hyclone) with 0.5% BSA (EMD Millipore) and 0.001% Sodium Azide (Sigma)). After two washes, the cells were resuspended in fixation buffer. After fixation, the cells were washed and treated with permeabilization buffer (Invitrogen) for 20 minutes at 4° C. followed by wash with permeabilization buffer (Invitrogen). The cells were then stained for an intracellular marker for proliferation (Ki67) for 30 minutes at RT. After two washes, the cells were resuspended in fixation buffer and analyzed by flow cytometry (Celesta-BD Bioscience).

As shown in FIGS. 233A and B, peripheral blood analysis showed that proliferative Ki67-positive NK and $CD8^+$ cells were predominantly present at day 3 post-TGFRt15-TGFRs+TA99 therapy, when compared to the saline or chemotherapy treatment groups. The expansion of NK and $CD8^+$ cells was found on days 3 and 5 post-immunotherapy. While the NK cells were still expanding, the $CD8^+$ cells was not found to be expanding in the blood at day 10 post-immunotherapy. These cells also expressed the activation markers CD25 and granzyme B post-TGFRt15-TGFRs+TA99 therapy, when compared to immune cells of the saline or chemotherapy treatment groups. These effects are consistent with the immunostimulatory activities of TGFRt15-TGFRs.

Example 102: TGFRt15-TGFRs Treatment Decreases Levels of TGFβ in the Plasma of B16F10 Tumor Bearing Mice C57BL/6 mice were subcutaneously injected with 0.5×$10^6$ B16F10 cells. After tumor inoculation (day 0), the mice were given three doses of doxetaxel chemotherapy (10 mg/kg) on days 1, 4, and 7 and single dose of TGFRt15-TGFRs (3 mg/kg) combined with monoclonal antibody targeting a tumor antigen anti-TYRP-1 antibody TA99 (200 µg) on day 8. Tumor-bearing mice treated with saline or doxetaxel chemotherapy (10 mg/kg) on days 1, 4, and 7 served as controls. Blood was collected from the submandibular on days 1, 3, 5, and 10 after immunotherapy treatment in tubes containing EDTA and immediately placed on ice. The blood was centrifuged for 15 minutes at 3,000 rpm at room temperature to separate plasma. Plasma samples were aliquoted and stored at −80° C. The plasma TGFβ levels were analyzed by using cytokine array, TGFβ 3-plex (TGFβ 1-3) from Eve Technologies, Calgary, AL, Canada.

As shown in FIG. 234, the results show that administration of TGFRt15-TGFRs+TA99 led to a reduction in the plasma levels of TGF-β1, TGF-β2, and TGF-β3 in tumor-bearing mice for 3 to 5 days post-treatment, when compared to the saline or chemotherapy treatment groups. This effect is consistent with the TGF-β agonistic activity of TGFRt15-TGFRs.

Example 103: TGFRt15-TGFRs Treatment Reduces Levels of Proinflammatory Cytokines in the Plasma of B16F10 Tumor Bearing Mice C57BL/6 mice were subcutaneously injected with 0.5× $10^6$ B16F10 cells. After tumor inoculation (day 0), the mice were given three doses of doxetaxel chemotherapy (10 mg/kg) on days 1, 4, and 7 and single dose of TGFRt15-TGFRs (3 mg/kg) combined with monoclonal antibody targeting a tumor antigen anti-TYRP-1 antibody TA99 (200 µg) on day 8. Tumor-bearing mice treated with saline or doxetaxel chemotherapy (10 mg/kg) on days 1, 4, and 7 served as controls. Blood was drawn from submandibular vein on days 1, 3, 5, and 10 after immunotherapy treatment (day 8) in tubes containing with EDTA and immediately placed on ice. The blood was centrifuged for 15 minutes at 3,000 rpm at room temperature to separate plasma. Plasma samples were aliquoted and stored at −80° C. Aliquots were diluted 2-fold in PBS and analyzed using a Mouse Cytokine Array Proinflammatory Focused 10-plex (MDF10) assay.

As shown in FIG. 235, the results show that administration of TGFRt15-TGFRs+TA99 reduced in plasma levels of IL2, IL-1β, IL6, MCP-1, and GM-CSF in tumor-bearing mice on day 10 post-treatment, when compared to the chemotherapy treatment group. This effect is consistent with the immunostimulatory activities of TGFRt15-TGFRs.

Example 104: TGFRt15-TGFRs Treatment Enhances NK and CD8+ Expansion in the Spleen of B16F10 Tumor Bearing Mice C57BL/6 mice were subcutaneously injected with 0.5× $10^6$ B16F10 cells. After tumor inoculation (day 0), the mice were given three doses of doxetaxel chemotherapy (10 mg/kg) on days 1, 4, and 7 and single dose of TGFRt15-TGFRs (3 mg/kg) combined with monoclonal antibody targeting a tumor antigen anti-TYRP-1 antibody TA99 (200 µg) on day 8. Tumor-bearing mice treated with saline or doxetaxel chemotherapy (10 mg/kg) on days 1, 4, and 7 served as controls. Mice were sacrificed and the spleens were harvested at days 3, 5, and 10 post-immunotherapy (day 8). The spleens were crushed with flat back end of the sterile piston/plunger of 3 cc syringe to release the splenocytes. The splenocytes were passed through a 70-pM cell strainer and homogenized into a single cell suspension. The RBCs were lysed in ACK lysis buffer and the splenocytes were washed and stained with antibodies for cell-surface expression of NK and CD8 (BioLegend), for 30 minutes at RT. After two washes, the cells were resuspended in fixation buffer and analyzed by flow cytometry (Celesta-BD Bioscience).

As shown in the FIG. 236, the expansion of NK and CD8+ cells were seen in the spleen at days 3 and 5 post-TGFRt15-TGFRs+TA99 therapy, when compared to the saline or chemotherapy treatment groups. Levels of NK cells (but not the CD8+ cells) were still found to be elevated at day 10 post-immunotherapy in the spleen of tumor-bearing mice, when compared levels in the spleens of the chemotherapy treatment group. These effects are consistent with the immunostimulatory activities of TGFRt15-TGFRs.

Example 105: TGFRt15-TGFRs Treatment Enhances Glycolytic Activity of Splenocytes in B16F10 Tumor Bearing Mice C57BL/6 mice were subcutaneously injected with 0.5× $10^6$ B16F10 cells. After tumor inoculation (day 0), the mice were given three doses of doxetaxel chemotherapy (10 mg/kg) on days 1, 4, and 7 and single dose of TGFRt15-TGFRs (3 mg/kg) combined with monoclonal antibody targeting a tumor antigen anti-TYRP-1 antibody TA99 (200 µg) on day 8. Tumor-bearing mice treated with saline or doxetaxel chemotherapy (10 mg/kg) on days 1, 4, and 7 served as controls. Mice were sacrificed and the spleens were harvested at days 3, 5, and 10 post-immunotherapy (day 8). The spleens were crushed with flat back end of the sterile piston/plunger of 3 cc syringe to release the splenocytes. The splenocytes were passed through a 70-µM cell strainer and homogenized into a single cell suspension. The RBCs were lysed in ACK lysis buffer and the splenocytes were washed and counted. To measure the glycolytic activity of the splenocytes, the cells were washed and resuspended in seahorse media and resuspended in $4 \times 10^6$ cells/mL. The cells were seeded at 50 µL/well in Cell-Tak-coated Seahorse Bioanalyzer XFe96 culture plates in Seahorse XF RPMI medium, pH 7.4 supplemented with 2 mM L-glutamine for glycolysis stress test. The cells were allowed to attach to the plate for 30 minutes at 37° C. Additionally, 130 µl, of the assay medium was added to each well of the plate (also the background wells). The plate was incubated in 37° C., non-$CO_2$ incubator for 1 hr. For glycolysis stress test the calibration plate contained 10× solution of glucose/oligomycin/2DG prepared in Seahorse assay media and 20 µL of glucose/oligomycin/2DG were added to each of the ports of the extracellular flux plate that was calibrated overnight. The glycolysis stress test is based on extracellular acidification rate (ECAR) and measures three key parameters of glycolytic function including glycolysis, glycolytic capacity, and glycolytic reserve. Complete ECAR analysis consisted of four stages: non glycolytic acidification (without drugs), glycolysis (10 mM glucose), maximal glycolysis induction/ glycolytic capacity (2 µM oligomycin), and glycolysis reserve (100 mM 2-DG). At the end of the experiment the data was exported as a Graph Pad Prism file. The XF glycolysis stress test report generator automatically calculated the XF cell glycolysis stress test parameters from the Wave data. The data was analyzed using the Wave software (Agilent).

As shown in the FIGS. 237A and B, the splenocytes isolated from tumor-bearing mice at day 3 and day 5 after TGFRt15-TGFRs+TA99 therapy showed enhanced basal glycolysis, capacity and reserve rate, when compared to splenocytes of the saline or chemotherapy treatment groups. However no significant difference in the splenocyte glycolytic activity was observed at day 10 post-immunotherapy.

These effects are consistent with the immunostimulatory activities of TGFRt15-TGFRs.

Example 106: TGFRt15-TGFRs Treatment Enhances Mitochondrial Respiration of Splenocytes in B16F10 Tumor Bearing Mice C57BL/6 mice were subcutaneously injected with 0.5× $10^6$ B16F10 cells. After tumor inoculation (day 0), the mice were given three doses of doxetaxel chemotherapy (10 mg/kg) on days 1, 4, and 7 and single dose of TGFRt15-TGFRs (3 mg/kg) combined with monoclonal antibody targeting a tumor antigen anti-TYRP-1 antibody TA99 (200 µg) on day 8. Tumor-bearing mice treated with saline or doxetaxel chemotherapy (10 mg/kg) on days 1, 4, and 7 served as controls. Mice were sacrificed and the spleens were harvested at days 3, 5, and 10 post-immunotherapy (day 8). The spleens were crushed with flat back end of the sterile piston/plunger of 3 cc syringe to release the splenocytes. The splenocytes were passed through a 70 µM cell strainer and homogenized into a single cell suspension. The RBCs were lysed in ACK lysis buffer and the splenocytes were washed and counted. To measure the mitochondrial respiration of the splenocytes, the cells were washed and resuspended in seahorse media and resuspended in 4×$10^6$ cells/mL. The cells were seeded at 50 µL/well in Cell-Tak-coated Seahorse Bioanalyzer XFe96 culture plates in Seahorse XF RPMI medium, pH 7.4 supplemented with 2 mM L-glutamine for glycolysis stress test. For mitochondrial stress test, the cells were seeded in Seahorse XF RPMI medium, pH 7.4 supplemented with 10 mM glucose and 2 mM L-glutamine. The cells were allowed to attach to the plate for 30 minutes at 37° C. Additionally, 130 µL of the assay medium was added to each well of the plate (also the background wells). The plate was incubated in 37° C., non-$CO_2$ incubator for 1 hr. For mitochondrial stress test, the Calibration plate contained 10× solution of oligomycin/FCCP/rotenone prepared in Seahorse assay media and 20 µL of oligomycin, FCCP, and rotenone was added to each of the ports of the extracellular flux plate that was calibrated overnight. Oxygen Consumption Rate (OCR) was measured using an XFe96 Extracellular Flux Analyzer. Complete OCR analysis consisted of four stages: basal respiration (without drugs), ATP-linked respiration/Proton leak (1.5 µM mM Oligomycin), maximal respiration (2 µM FCCP), and spare respiration (0.5 µM Rotenone). At the end of the experiment, the data was exported as a Graph Pad Prism file. The XF mitochondrial stress test report generator automatically calculates the XF mitochondrial stress test parameters from the Wave data that have been exported to Excel. The data was analyzed by using the Wave software (Agilent).

As shown in the FIGS. 238A and B, the splenocytes isolated from tumor-bearing mice at day 3 and day 5 after TGFRt15-TGFRs+TA99 therapy showed enhanced basal respiration, mitochondria respiration, capacity and ATP production, when compared to splenocytes of the saline or chemotherapy treatment groups. However no significant difference in the splenocyte mitochondrial respiration was observed at day 10 post-immunotherapy. These effects are consistent with the immunostimulatory activities of TGFRt15-TGFRs. Metabolic pathways like oxidative metabolism and glycolysis are known to preferentially fuel the cell fate decisions and effector functions of immune cells. Therefore, TGFRt15-TGFRs mediated increased glycolytic activity and mitochondrial respiration might be associated with the activation of NK and $CD8^+$ immune cells in the blood, spleen, and tumor of the mice.

Example 107: TGFRt15-TGFRs Treatment Enhances NK and CD8 Immune Cell Infiltration (TILs) into Tumors of B16F10 Tumor Bearing Mice C57BL/6 mice were subcutaneously injected with 0.5× $10^6$ B16F10 cells. After tumor inoculation (day 0), the mice were given three doses of doxetaxel chemotherapy (10 mg/kg) on days 1, 4, and 7 and single dose of TGFRt15-TGFRs (3 mg/kg) combined with monoclonal antibody targeting a tumor antigen anti-TYRP-1 antibody TA99 (200 µg) on day 8. Tumor-bearing mice treated with saline or doxetaxel chemotherapy (10 mg/kg) on days 1, 4, and 7 served as controls. Mice were sacrificed and the tumors were harvested at days 3, 5, and 10 post-immunotherapy. The tumor tissue was dissociated into single cell suspension by collagenase digestion to determine the tumor-infiltrating immune cells. The single cell suspension was layered on Ficoll-Paque media followed by density gradient centrifugation to separate the lymphocytes and tumor cells. The cells were centrifuged at 1000 g for 20 minutes at 20° C. with slow acceleration and break turned off. After centrifugation the Ficoll-Paque results in a distinct separation between two layers. The TILs are found on the interface between the media and Ficoll-Paque, while the pellet consists of the tumor cells. The TILs were carefully removed from the interface and washed with complete RPMI media. After washing, the RBCs were lysed in ACK buffer for 5 minutes at room temperature. The cells were washed in FACS buffer (1×PBS (Hyclone) with 0.5% BSA (EMD Millipore) and 0.001% Sodium Azide (Sigma)). To assess the different types of immune cells in tumor, the cells were stained with antibodies for cell-surface CD8, NK1.1, CD25, and GzB (BioLegend) for 30 minutes at RT. After surface staining, the remaining cells were washed (1500 RPM for 5 minutes at room temperature) in FACS buffer (1×PBS (Hyclone) with 0.5% BSA (EMD Millipore) and 0.001% Sodium Azide (Sigma)). After two washes, the cells were resuspended in fixation buffer. After fixation cells were washed and treated with permeabilization buffer (Invitrogen) for 20 minutes at 4° C. followed by wash with permeabilization buffer (Invitrogen). The cells were then stained for intracellular markers for proliferation (Ki67) for 30 minutes at RT. After two washes, the cells were resuspended in fixation buffer and analyzed by flow cytometry (Celesta-BD Bioscience). As shown in FIGS. 239A and B, tumor analysis showed high levels of Ki67-positive NK and CD8 cells at day 3 post-therapy. Expansion of NK and $CD8^+$ cells (based on of lymphocytes in tumors) was found at day 3 and day 5 post-TGFRt15-TGFRs+TA99 therapy, when compared to the chemotherapy treatment group. Tumors $CD8^+$ cells were elevated even at day 10 post-immunotherapy. Both NK and $CD8^+$ showed the expression of activation markers CD25 and granzyme B at day 3 post-TGFRt15-TGFRs+TA99 therapy, when compared to immune cells of the chemotherapy treatment group. These effects are consistent with the immunostimulatory activities of TGFRt15-TGFRs and are comparable to changes seen in the blood and splenocytes of tumor-bearing mice.

Example 108: Histopathological Analysis of Tumors Following TGFRt15-TGFRs Treatment C57BL/6 mice were subcutaneously injected with 0.5× $10^6$ B16F10 cells. After tumor inoculation (day 0), the mice were given three doses of doxetaxel chemotherapy (10 mg/kg) on days 1, 4, and 7 and single dose of TGFRt15-TGFRs (3 mg/kg) combined with monoclonal antibody targeting a tumor antigen anti-TYRP-1 antibody TA99 (200 µg) on day 8. Tumor-bearing mice treated with saline or doxetaxel chemotherapy (10 mg/kg) on days 1, 4, and 7 served as controls. Blood was drawn from submandibular vein on days 1, 3, 5, and 10 after immunotherapy treatment (day 8). On day 10 post-immunotherapy, the mice were sacrificed, and tumors were isolated. For the histological analysis, tumor samples were fixed in 10% formalin solution and were embedded in paraffin and cut at 5 µm. The sections were stained with H & E to assess tissue and cellular morphology. The slides were scored based on the mitotic and necrotic activity of the tumor. The percentage necrosis in the tumor was scored as, +1 (0-20%), +2 (20-40%), and +3 (40-60%). The Mitotic Index of the tumor was scored as +1=Moderate (1-5 per high power field) and +2=Extensive (>5 per high power field).

As shown in FIG. 240, following TGFRt15-TGFRs+TA99 treatment, tumors displayed less mitotic and necrotic activity. The mitotic index is correlated to the dividing cells and presence of necrosis is a measure of more aggressive features and poor prognosis. Hence TGFRt15-TGFRs is a promising therapy in pre-clinical murine models for testing of combination tumor immunotherapy.

Example 109: Anti-PD-L1 Antibody in Combination with TGFRt15-TGFRs+TA99 and Chemotherapy in B16F10 Melanoma Mouse Model C57BL/6 mice were subcutaneously injected with $0.5 \times 10^6$ B16F10 cells. After tumor inoculation (day 0), the mice were given three doses of doxetaxel chemotherapy (10 mg/kg) on days 1, 4, and 7. Tumor-bearing mice treated with only saline or doxetaxel chemotherapy (10 mg/kg) on days 1, 4, and 7 served as controls. The remaining mice were randomized in two groups, one group was treated with anti-mPD-L1 antibody (2×10 mg/kg) and the other group was treated with TGFRt15-TGFRs (3 mg/kg) with TA99 (200 µg) on day 8. After 6 days, the mice which received the TGFRt15-TGFRs with TA99 were given anti-mPD-L1 antibody (2×10 mg/kg) and mice which received anti-mPD-L1 antibody were treated with TGFRt15-TGFRs (3 mg/kg) with TA99 (200 µg). The anti-mPD-L1 antibody was given as two doses on days 8 and 10 or days 14 and 16. Tumor growth was monitored by caliper measurement, and tumor volume was calculated using the formula V=(L×W2)/2, where L is the largest tumor diameter and W is the perpendicular tumor diameter. N=6-8 mice/group.

As shown in the FIG. 241, TGFRt15-TGFRs+TA99 administration following by anti-PD-L1 antibody treatment resulted in better antitumor activity in B16F10 tumor-bearing mice as compared to treatment with anti-PD-L1 antibody and then TGFRt15-TGFRs+TA99. Therefore, combining TGFRt15-TGFRs with anti-PD-L1 antibody may be advantageous in treating tumors that are resistance to anti-PD-L1 antibody therapy.

Example 110: Anti-Tumor Efficacy of TGFRt15-TGFRs in B16F10 Melanoma Mouse Model is Dependent on NK and CD8+ T Cells Groups of C57BL/6 mice (N=6-8 mice/group) were treated with three doses of NK1.1 Ab (500 µg) or CD8+a (500 µg) antibody intraperitoneal every third day to deplete the NK and CD8 cells. Blood was drawn and analyzed for NK and CD8+ lymphocyte levels before the B16F10 tumor implantation. Untreated mice served as immunocompetent controls. C57BL/6 mice were subcutaneously injected with $0.5 \times 10^6$ B16F10 cells. After tumor inoculation (day 0), the mice were given three doses of docetaxel (10 mg/kg) on days 1, 4, and 7, followed by single dose of TGFRt15-TGFRs (3 mg/kg)+TA99 (200 µg) on day 8. Tumor growth was monitored by caliper measurement, and tumor volume was calculated using the formula V=(L×W2)/2, where L is the largest tumor diameter and W is the perpendicular tumor diameter.

As shown in FIG. 242, B16F10 tumor bearing mice treated with TGFRt15-TGFRs in combination with TA99 and chemotherapy showed a significant reduction in B16F10 tumor volume, when compared to tumors of the saline or chemotherapy treatment groups. However, when the mice were depleted for NK and CD8+ cell subsets, there was no effect of immunotherapy on the anti-antitumor activity. This experiment shows that both the NK and CD8+ immune cells play an important role in TGFRt15-TGFRs mediated anti-tumor activity.

Example 111: Comparison of TGFRt15-TGFRs and TGFRt15*-TGFRs Treatment in Reducing Senescence Markers in Liver and Lung Tissues of B16F10 Tumor-Bearing Mice Following Chemotherapy C57BL/6, 6-8-week-old mice were purchased from the Jackson Laboratory. Mice were housed in a temperature and light controlled environment. Mice were divided into five groups as follows: saline control group (n=7), docetaxel (DTX) group (n=7), DTX+TGFRt15-TGFRs group (n=7), DTX+TGFRt15*-TGFRs group (n=7), and DTX+IL15SA group (n=7). B16F10 tumor cells ($1 \times 10^7$ cells/mouse) were implanted in mice on day 0. The mice were treated subcutaneously with 10 mg/kg docetaxel on days 1, 4, and 7. On day 8, the mice were treated subcutaneously with PBS, TGFRt15-TGFRs (3 mg/kg), TGFRt15*-TGFRs (3 mg/kg), or IL15SA (0.5 mg/kg). The mice were euthanized day 17 post-treatment and liver and lungs were harvested in order to evaluate the gene expression of senescence markers p21, IL-1α, and IL6 for liver and p21 and IL-1α for lung by quantitative-PCR in tissues after treatment with TGFRt15-TGFRs or TGFRt15*-TGFRs and control groups. Harvested organs were stored in liquid nitrogen in 1.7 mL Eppendorf tubes. The samples were homogenized by using homogenizer in 1 mL of Trizol (Thermo Fischer). Homogenized tissues were transferred in fresh Eppendorf tubes. Total RNA was extracted using RNeasy Mini Kit (Qiagen #74106) according to the manufacturer's instructions. One µg of total RNA was used for cDNA synthesis using the QuantiTect Reverse Transcription Kit (Qiagen). Real-time PCR was carried out with CFX96 Detection System (Bio-Rad) using FAM-labeled predesigned primers purchased from Thermo Scientific. Reactions were run in triplicate for all the genes examined. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct=Ct_{target}-Ct_{18S}$.

As shown in FIG. 243, the senescence markers p21, IL-1α, and IL6 showed decreased gene expression in liver (A) and lung (B) tissues in both TGFRt15-TGFRs and TGFRt15*-TGFRs-treated tumor bearing mice, when compared to gene expression in tissues of chemotherapy treated mice.

Example 112: TGFRt15-TGFRs Treatment in Reducing Chemotherapy-induced Senescent Tumor Cells In Vivo B16F10 melanoma cells were stably transduced with GFP lentiviral plasmid and the GFP-expressing tumor cells (B16F10-GFP) were selected by growth in puromycin containing media. Almost 95% B16F10 melanoma cells were GFP-positive as analyzed by FACS. To induce senescence, B16F10-GFP cells were treated with 7.5 µM docetaxel (DTX) for 3 days followed by 4 days recovery in the normal growth media. To quantify gene expression of senescence markers and NK cell ligands, docetaxel-treated B16F10 GFP cells (B16F10-GFP-SNC) were homogenized by using homogenizer in 1 mL of Trizol (Thermo Fischer). Homogenized cells were transferred in fresh Eppendorf tubes. Total RNA was extracted using RNeasy Mini Kit (Qiagen #74106) according to the manufacturer's instructions. One µg of total RNA was used for cDNA synthesis using the QuantiTect Reverse Transcription Kit (Qiagen). Real-time PCR was carried out with CFX96 Detection System (Bio-Rad) using FAM-labeled predesigned primers purchased from Thermo Scientific. The reactions were run in triplicate for all the genes examined. The housekeeping gene 18S ribosomal RNA was used as an internal control to normalize the variability in expression levels. The expression of each target mRNA relative to 18S rRNA was calculated based on Ct as $2^{-\Delta(\Delta Ct)}$, in which $\Delta Ct = Ct_{target} - Ct_{18S}$. The expression of different genes is plotted as fold-change in B16F10-GFP-SNC cells as compared to untreated B16F10-GFP cells.

As shown in FIG. 244, real time PCR analysis showed that B16F10-GFP cells treated in vitro with docetaxel upregulated gene expression of senescence markers, p21, H2AX, and IL6, and NK cell ligands, Rae-le and ULBP-1, when compared to untreated B16F10-GFP cells.

To determine whether chemotherapy-induced senescence tumor cells are reduced by immunotherapy in vivo, B16F10 parental melanoma cells ($0.75 \times 10^6$) were mixed with B16F10-GFP-SNC cells ($0.75 \times 10^6$) and injected the cell mixture subcutaneously in C57BL/6 mice. Mice were also injected with B16F10 and B16F10-GFP cells as controls. The B16F10 parent cells will grow to form tumor and B16F10-GFP-SNC cells will be the part of the tumor microenvironment. When tumors reached to approximately 350 mm$^3$, mice bearing the mixed tumors were divided into 2 groups. One group received PBS as control and the other group received TGFRt15-TGFRs (3 mg/kg) with TA99 (200 µg) subcutaneously. The mice were sacrificed day 4 post-immunotherapy treatment. The tumor tissue was dissociated into single cell suspension by collagenase digestion to determine the tumor-infiltrating immune cells. The single cell suspension was layered on Ficoll-Paque media followed by density gradient centrifugation to separate the lymphocytes and tumor cells. The cells were centrifuged at 1000 g for 20 minutes at 20° C. with slow acceleration and break turned off. After centrifugation the Ficoll-Paque results in a distinct separation between two layers. The TILs are found on the interface between the media and Ficoll-Paque, while the pellet consists of the tumor cells. The TILs were carefully removed from the interface and washed with complete RPMI media. After washing, the RBCs were lysed in ACK buffer for 5 minutes at room temperature. The remaining cells were washed in FACS buffer (1×PBS (Hyclone) with 0.5% BSA (EMD Millipore) and 0.001% Sodium Azide (Sigma)). To assess the different types of immune cells in tumor, the cells were stained with antibodies specific to cell-surface CD3, CD45, CD8, and NK1.1 (BioLegend) for 30 minutes at RT. After surface staining, cells were washed (1500 RPM for 5 minutes at room temperature) in FACS buffer (1×PBS (Hyclone) with 0.5% BSA (EMD Millipore) and 0.001% Sodium Azide (Sigma)). After two washes, the cells were resuspended in fixation buffer. After fixation, the cells were washed and treated with permeabilization buffer (Invitrogen) for 20 minutes at 4° C. followed by wash with permeabilization buffer (Invitrogen). The cells were then stained for intracellular markers (Ki67) for proliferation for 30 minutes at RT. After two washes, the cells were resuspended in fixation buffer and analyzed by flow cytometry (Celesta-BD Bioscience).

As shown in FIG. 245, the percentage of CD8$^+$ T cells and natural killer (NK) cells were increased after 4 days post-treatment in the tumor following TGFRt15-TGFRs+TA99 treatment, compared to controls. These results demonstrate that TGFRt15-TGFRs is able to stimulate infiltration of CD8$^+$ T cells and NK cells in the tumor. Both CD8$^+$ T cells and NK immune cells were also able to proliferate in the tumor as measured by the Ki67 marker.

To determine whether chemotherapy-induced senescence tumor cells are reduced by immunotherapy in vivo, B16F10 parental melanoma cells ($0.75 \times 10^6$) were mixed with B16F10-GFP-SNC cells ($0.75 \times 10^6$) and injected the cell mixture subcutaneously in C57BL/6 mice. Mice were also injected with B16F10 and B16F10-GFP cells as controls. The B16F10 parent cells will grow to form tumor and B16F10-GFP-SNC cells will be the part of the tumor microenvironment. When tumors reached to approximately 350 mm$^3$, mice bearing the mixed tumors were divided into 2 groups. One group received PBS as control and the other group received TGFRt15-TGFRs (3 mg/kg) with TA99 (200 µg) subcutaneously. The mice were sacrificed after day 4 and day 10 post-immunotherapy treatment. The tumor tissue was dissociated into single cell suspension by collagenase digestion to determine the tumor-infiltrating immune cells and GFP-positive cells in the tumor. Flow cytometry analysis (FIG. 246A) on tumor cells showed that mice which received immunotherapy treatment showed lower number of GFP-positive cells 4 days and 10 days post-treatment as compared to the PBS control group. Tumor cells were plated in a 24-well plate to evaluate by fluorescence microscopy (FIG. 246B).

Microscopic images also showed fewer GFP-positive cells in the tumor of immunotherapy-treated mice as compared to the control PBS-treated group. The GFP expression in the tumor is associated with the chemotherapy-induced B16F10-GFP senescence cells, therefore reduction in the GFP expression after immunotherapy treatment shows the successful elimination of senescence tumor cells in the tumor bearing mice.

Example 113: TGFβ Levels in Kidney after Inducing Kidney Injury by Cisplatin and Treatment with TGFRt15-TGFRs by Tissue ELISA The mouse kidney was harvested in order to evaluate changes in protein levels of the senescence markers TGF β after inducing kidney injury by cisplatin and treatment with TGFRt15-TGFRs. C57BL/6, 8-week-old mice were purchased from the Jackson Laboratory. The mice were housed in a temperature and light controlled environment. The mice were injected with cisplatin (5 mg/kg, intraperitoneal)

weekly for 3 weeks to induce kidney injury. One week after cisplatin, the mice were treated with either PBS or TGFRt15-TGFRs (3 mg/kg) (n=8/group). The mice were euthanized after 30 days of immunotherapy treatment and kidney were harvested and stored in liquid nitrogen in 1.7 mL-Eppendorf tubes. The samples were homogenized by using homogenizer in 0.3 mL of extraction buffer (Abeam). Homogenized tissues were transferred in fresh Eppendorf tubes. Protein levels in homogenized tissue were quantified using BCA Protein Assay Kit (Pierce). Mouse TGFβ ELISA (R&D System) was performed in 200 lag of tissue. The concentration of TGFβ was calculated in per milligram of tissue.

As shown in FIG. 247, the TGFβ level decreased in TGFRt15-TGFRs treated mice kidney compared to PBS control group. These results indicate that TGFRt15-TGFRs treatment is capable of provide long lasting activity in reducing TGFβ levels in tissues of chemotherapy-treated mice.

Example 114: Toxicity of Subcutaneous Administration of TGFRt15-TGFRs in Mice

To further assess the dose-dependent toxicological effects of TGFRt15-TGFRs, female C57BL/6 mice (N=3/group) were administered one or two (every two weeks) subcutaneous doses of PBS or TGFRt15-TGFRs at 3, 10, 50, and 200 mg/kg. Animals were monitored for signs of study drug-related toxicities, changes in body weight during the study period and hematology and serum chemistry parameters at day 7 post-dosing. Mice receiving 200 mg/kg TGFRt15-TGFRs exhibited significant body weight loss beginning 4 days after the first injection (study day (SD) 0) and reaching a nadir between SD6-9, before returning to pre-dose levels by SD11 (FIG. 248A). Mortality was observed in one mouse of the 200 mg/kg group on SD9. There were no apparent treatment-mediated effects on body weight or other clinical signs in any other dose group or after the second TGFRt15-TGFRs dose at 200 mg/kg. Spleen weights increased in a dose dependent manner following one or two doses of TGFRt15-TGFRs (FIG. 248B). Compared to the PBS group, mice also exhibited a 25-fold increase in WBC counts 7 days after a single 200 mg/kg dose of TGFRt15-TGFRs, which remained 5-fold higher 7 days after the second 200 mg/kg dose (FIG. 248C, Tables 3 and 4). WBC subset analysis showed a 16-fold increase in absolute lymphocyte counts and >50-fold increase in neutrophil, monocyte, eosinophil, and basophil counts at SD7 in the 200 mg/kg group. These changes were not observed at lower TGFRt15-TGFRs dose levels but were similar to those reported for C57BL/6 mice treated subcutaneously treatment with IL-15/IL-15Rα complexes (Liu et al., *Cytokine* 107: 105-112, 2018). Other hematology and serum chemistry parameters were similar in the TGFRt15-TGFRs and PBS treated animals and were generally within expected ranges for C57BL/6 mice (Tables 3 and 4). TGFRt15-TGFRs-mediated effects were greatest 7 days after the first dose and were reduced after the second dose, consistent with previous studies showing decreased immune responses in mice following repeat dosing with IL-15/IL-15Rα (Elpek et al., *PNAS* 107: 21647-21652, 2010; Frutoso et al., *J Immunol* 201: 493-506, 2018). Overall, TGFRt15-TGFRs was well tolerated by C57BL/6 mice at dose levels up to of 50 mg/kg.

TABLE 3

Hematology and serum chemistry parameters of C57BL/6 mice on Study Day 7 after single dose of TGFRt15-TGFRs.

| Study Day 7 | PBS | | | TGFRt15-TGFRs | | | | | | | | | | | |
| | | | | 3 mg/kg | | | 10 mg/kg | | | 50 mg/kg | | | 200 mg/kg | | |
| Parameters | Mean | SD | N | Mean | SD | N | Mean | SD | N | Mean | SD | N | Mean | SD | N |
| --- | --- | --- | --- | --- | --- | --- | --- | --- | --- | --- | --- | --- | --- | --- | --- |
| WBC count ($\times 10^3/\mu L$) | 6.53 | 1.80 | 3 | 6.63 | 1.37 | 3 | 5.07 | 1.53 | 3 | 11.57 | 2.99 | 3 | 165.37 | 2.20 | 3 |
| RBC count ($\times 10^6/\mu L$) | 7.59 | 0.90 | 3 | 6.44 | 0.34 | 3 | 7.03 | 0.34 | 3 | 6.56 | 0.68 | 3 | 6.25 | 0.84 | 3 |
| Hemoglobin (g/dL) | 10.1 | 0.8 | 3 | 9.3 | 0.0 | 3 | 9.6 | 0.3 | 3 | 8.7 | 1.1 | 3 | 9.4 | 1.2 | 3 |
| Hematocrit (%) | 36.0 | 3.2 | 3 | 31.8 | 2.3 | 3 | 33.0 | 1.9 | 3 | 30.8 | 3.3 | 3 | 29.9 | 4.0 | 3 |
| MCV(fL) | 47.3 | 1.5 | 3 | 49.3 | 1.5 | 3 | 46.7 | 0.6 | 3 | 47.0 | 0.0 | 3 | 48.0 | 0.0 | 3 |
| MCH (pg) | 13.3 | 0.6 | 3 | 14.3 | 0.6 | 3 | 13.7 | 0.6 | 3 | 13.3 | 0.6 | 3 | 15.0 | 1.0 | 3 |
| MCHC (%) | 28.0 | 0.0 | 3 | 29.7 | 2.1 | 3 | 29.0 | 1.0 | 3 | 28.3 | 1.5 | 3 | 31.3 | 1.5 | 3 |
| Neutrophils ($\times 10^3/\mu L$) | 0.82 | 0.42 | 3 | 0.91 | 0.28 | 3 | 0.53 | 0.11 | 3 | 1.32 | 0.43 | 3 | 51.25 | 0.97 | 3 |
| Lymphocytes ($\times 10^3/\mu L$) | 5.46 | 1.31 | 3 | 5.39 | 0.9 | 3 | 4.26 | 1.34 | 3 | 9.47 | 2.34 | 3 | 86.01 | 2.80 | 3 |
| Monocytes ($\times 10^3/\mu L$) | 0.18 | 0.08 | 3 | 0.24 | 0.21 | 3 | 0.24 | 0.07 | 3 | 0.69 | 0.20 | 3 | 18.17 | 2.68 | 3 |
| Eosinophils ($\times 10^3/\mu L$) | 0.07 | 0.02 | 3 | 0.06 | 0.02 | 3 | 0.05 | 0.02 | 3 | 0.08 | 0.08 | 3 | 7.73 | 2.02 | 3 |
| Basophils ($\times 10^3/\mu L$) | 0.02 | 0.03 | 3 | 0.03 | 0.05 | 3 | 0.00 | 0.00 | 3 | 0.00 | 0.00 | 3 | 2.21 | 0.99 | 3 |
| Platelet count ($\times 10^3/\mu L$) | 558.3 | 81.1 | 3 | 692.3 | 55.8 | 3 | 886.0 | 53.6 | 3 | 1004.3 | 60.2 | 3 | 467.3 | 32.5 | 3 |
| % Neutrophils | 12.0 | 3.0 | 3 | 13.7 | 3.1 | 3 | 10.7 | 1.2 | 3 | 11.3 | 1.2 | 3 | 31.0 | 1.0 | 3 |
| % Lymphocytes | 84.0 | 3.0 | 3 | 81.7 | 3.8 | 3 | 83.7 | 1.5 | 3 | 82.0 | 1.0 | 3 | 52.0 | 1.0 | 3 |
| % Monocytes | 2.67 | 0.58 | 3 | 3.33 | 2.31 | 3 | 4.67 | 0.58 | 3 | 6.00 | 1.00 | 3 | 11.00 | 1.73 | 3 |
| % Eosinophils | 1.00 | 0.00 | 3 | 1.00 | 0.00 | 3 | 1.00 | 0.00 | 3 | 0.67 | 0.58 | 3 | 4.67 | 1.15 | 3 |
| % Basophils | 0.33 | 0.58 | 3 | 0.33 | 0.58 | 3 | 0.00 | 0.00 | 3 | 0.00 | 0.00 | 3 | 1.33 | 0.58 | 3 |
| AST (U/L) | 84.3 | 28.2 | 3 | 69.0 | 9.2 | 3 | 137.7 | 108.6 | 3 | 71.7 | 2.5 | 3 | 162.3 | 11.8 | 3 |
| ALT (U/L) | 41.3 | 10.0 | 3 | 47.3 | 1.5 | 3 | 38.3 | 5.5 | 3 | 56.3 | 11.2 | 3 | 121.0 | 52.8 | 3 |
| Alkaline Phos. (U/L) | 113.7 | 17.0 | 3 | 112.0 | 8.7 | 3 | 248.3 | 218.8 | 3 | 95.0 | 7.8 | 3 | 83.0 | 16.6 | 3 |

TABLE 3-continued

Hematology and serum chemistry parameters of C57BL/6 mice on Study Day 7 after single dose of TGFRt15-TGFRs.

| Study Day 7 | PBS | | | TGFRt15-TGFRs | | | | | | | | | | |
|---|---|---|---|---|---|---|---|---|---|---|---|---|---|---|
| | | | | 3 mg/kg | | | 10 mg/kg | | | 50 mg/kg | | | 200 mg/kg | | |
| Parameters | Mean | SD | N | Mean | SD | N | Mean | SD | N | Mean | SD | N | Mean | SD | N |
| Total Bilirubin (mg/dL) | 0.87 | 0.47 | 3 | 0.33 | 0.15 | 3 | 0.45 | 0.07 | 2 | 0.20 | 0.00 | 2 | ND | ND | ND |
| BUN (mg/dL) | 23.0 | 2.6 | 3 | 21.0 | 3.5 | 3 | 24.7 | 4.6 | 3 | 21.3 | 2.9 | 3 | 18.7 | 7.2 | 3 |

TABLE 4

Hematology and serum chemistry parameters of C57BL/6 mice on Study Day 21 after two doses of TGFRt15-TGFRs.

| Study Day 21 | TGFRt15-TGFRs | | | | | | | | | | | |
|---|---|---|---|---|---|---|---|---|---|---|---|---|
| | 3 mg/kg | | | 10 mg/kg | | | 50 mg/kg | | | 200 mg/kg | | |
| Parameters | Mean | SD | N | Mean | SD | N | Mean | SD | N | Mean | SD | N |
| WBC count ($\times 10^3/\mu L$) | 5.37 | 3.13 | 3 | 5.63 | 0.75 | 3 | 6.37 | 2.02 | 3 | 31.45 | 40.38 | 2 |
| RBC count ($\times 10^6/\mu L$) | 6.37 | 1.67 | 3 | 7.45 | 0.62 | 3 | 6.82 | 0.67 | 3 | 7.13 | 0.18 | 2 |
| Hemoglobin (g/dL) | 9.0 | 2.1 | 3 | 10.1 | 0.8 | 3 | 9.7 | 0.7 | 3 | 10.5 | 0.8 | 2 |
| Hematocrit (%) | 30.3 | 7.2 | 3 | 35.6 | 3.5 | 3 | 33.7 | 2.2 | 3 | 36.2 | 3.5 | 2 |
| MCV(fL) | 47.7 | 2.3 | 3 | 47.7 | 1.2 | 3 | 49.7 | 2.1 | 3 | 50.5 | 3.5 | 2 |
| MCH (pg) | 14.0 | 1.0 | 3 | 13.3 | 0.6 | 3 | 14.3 | 0.6 | 3 | 14.5 | 0.7 | 2 |
| MCHC (%) | 30.0 | 0.0 | 3 | 28.3 | 1.5 | 3 | 28.7 | 0.6 | 3 | 28.5 | 0.7 | 2 |
| Neutrophils ($\times 10^3/\mu L$) | 0.65 | 0.50 | 3 | 0.62 | 0.07 | 3 | 1.10 | 0.55 | 3 | 6.78 | 9.09 | 2 |
| Lymphocytes ($\times 10^3/\mu L$) | 4.58 | 2.62 | 3 | 4.81 | 0.61 | 3 | 4.88 | 1.20 | 3 | 20.75 | 25.82 | 2 |
| Monocytes ($\times 10^3/\mu L$) | 0.13 | 0.08 | 3 | 0.19 | 0.06 | 3 | 0.24 | 0.13 | 3 | 3.32 | 4.65 | 2 |
| Eosinophils ($\times 10^3/\mu L$) | 0.01 | 0.01 | 3 | 0.02 | 0.03 | 3 | 0.12 | 0.12 | 3 | 0.62 | 0.83 | 2 |
| Basophils ($\times 10^3/\mu L$) | 0.00 | 0.00 | 3 | 0.00 | 0.00 | 3 | 0.03 | 0.05 | 3 | 0.00 | 0.00 | 2 |
| Platelet count ($\times 10^3/\mu L$) | 531.3 | 413.1 | 3 | 806.3 | 125.2 | 3 | 778.0 | 34.9 | 3 | 711.5 | 44.5 | 2 |
| % Neutrophils | 10.3 | 6.0 | 3 | 11.0 | 1.0 | 3 | 16.7 | 2.9 | 3 | 17.0 | 7.1 | 2 |
| % Lymphocytes | 87.0 | 6.0 | 3 | 85.3 | 1.5 | 3 | 77.7 | 5.1 | 3 | 75.5 | 14.8 | 2 |
| % Monocytes | 2.33 | 0.58 | 3 | 3.33 | 0.58 | 3 | 3.67 | 1.53 | 3 | 6.00 | 7.07 | 2 |
| % Eosinophils | 0.33 | 0.58 | 3 | 0.33 | 0.58 | 3 | 1.67 | 1.15 | 3 | 1.50 | 0.71 | 2 |
| % Basophils | 0.00 | 0.00 | 3 | 0.00 | 0.00 | 3 | 0.33 | 0.58 | 3 | 0.00 | 0.00 | 2 |
| AST (U/L) | 108.3 | 76.8 | 3 | 62.3 | 5.0 | 3 | 560.7[a] | 888.2 | 3 | 198.5 | 190.2 | 2 |
| ALT (U/L) | 49.3 | 17.7 | 3 | 51.0 | 12.5 | 3 | 57.7 | 3.5 | 3 | 48.0 | 9.9 | 2 |
| Alkaline Phos. (U/L) | 110.3 | 12.4 | 3 | 121.0 | 18.0 | 3 | 174.7 | 99.4 | 3 | 138.0 | 5.7 | 2 |
| Total Bilirubin (mg/dL) | 0.57 | 0.12 | 3 | 0.47 | 0.15 | 3 | 0.45 | 0.07 | 2 | 0.65 | 0.07 | 2 |
| BUN (mg/dL) | 27.0 | 5.0 | 3 | 22.3 | 4.2 | 3 | 24.3 | 2.1 | 3 | 25.0 | 1.4 | 2 |

[a] One of three mice in 50 mg/kg TGFRt15-TGFRs group had an observed AST value of 1586 U/L (~6 × ULN). This mouse did not show clinical signs and its ALT value (61 U/L) was within the normal range.

Example 115: Sequestration of TGF-β by TGFRt15-TGFRs and TGFRt15*-TGFRs in Mice Female C57BL/6 mice were injected subcutaneously with PBS or 3 mg/kg of TGFRt15-TGFRs or TGFRt15*-TGFRs and plasma was collected at various times post-treatment. Plasma levels of TGF-β1 and TGF-02 were determined using the TGFβ 3-Plex assay (Eve Technologies, Calgary, AL, Canada). TGFRt15-TGFRs and TGFRt15*-TGFRs were found to significantly decrease plasma TGF-β1 and TGF-β2 levels in C57BL/6 mice 2 days after treatment (FIG. 249), consistent with the activity of the TGFβRII domains of these fusion proteins.

Example 116: Effects of TGFRt15-TGFRs and TGFRt15*-TGFRs on Immune Cell Metabolism In Vivo and In Vitro To assess treatment mediated effects on immune cell metabolism, extracellular flux assays were performed on splenocytes isolated from mice 4 days after PBS, TGFRt15-TGFRs, TGFRt15*-TGFRs or IL-15/IL-15R (IL15SA) administration. Extracellular flux assays on mouse splenocytes were performed using a XFp Analyzer (Seahorse Bioscience). As expected, TGFRt15-TGFRs and IL-15 increased the rates of glycolytic capacity (ECAR) (FIG. 250A) and mitochondrial respiratory capacity (OCR) (FIG. 250B) of the isolated splenocytes in a dose-level-dependent manner. In vivo TGFRt15*-TGFRs treatment also increased ECAR and OCR of splenocytes. This phenomenon was not observed when splenocytes from untreated C57BL/6 mice were incubated 4 days with TGFRt15*-TGFRs in vitro. Only TGFRt15-TGFRs (but not TGFRt15*-TGFRs) was capable of increasing splenocyte ECAR and OCR in vitro at physiologically relevant concentrations (FIGS. 251A-251B). This suggests that both the IL-15 and TGFβRII domains of TGFRt15-TGFRs have a role in stimulating immune cell metabolism in vivo.

Example 117: Antitumor Efficacy of TGFRt15-TGFRs and TGFRt15*-TGFRs Against B16F10 Melanoma in C57BL/6 Mice To evaluate TGFRt15-TGFRs and TGFRt15*-TGFRs antitumor efficacy, the murine B16F10 tumor model was selected as it is highly aggressive, poorly immunogenic and devoid of immune infiltrates, expresses TGF-β which plays a role in its growth and is resistant to cytokine and checkpoint blockade immunotherapies. B16F10 melanoma cells ($5 \times 10^5$ cells) (CRL-6475, ATCC) were subcutaneously injected into C57BL/6 mice followed by subcutaneous injection of PBS, TGFRt15-TGFRs (3 or 20 mg/kg) or TGFRt15*-TGFRs (3 or 20 mg/kg) on day 1 and 4 after tumor implantation. Tumor volume was measured every other day and mice with tumors ≥4000 mm$^3$ were sacrificed per IACUC regulation. Mouse survival was also assessed throughout the study period. When compared through SD15 (i.e., prior to animal mortality), treatment with TGFRt15-TGFRs or TGFRt15*-TGFRs at 20 mg/kg resulted in significantly slower tumor growth than was observed in the PBS treated mice (FIG. 252A). Tumor-bearing mice treated with 20 mg/kg TGFRt15-TGFRs also showed prolonged survival when compared to the 3 mg/kg TGFRt15-TGFRs and PBS treatment groups (FIG. 252B). These results indicate that TGFRt15-TGFRs and TGFRt15*-TGFRs have antitumor activity against solid B16F10 melanoma tumors with the bifunctional TGFRt15-TGFRs complex exhibiting the greater efficacy. Thus, both the TGFβRII and IL-15/IL-15RαSu domains play a role in TGFRt15-TGFRs-mediated activity against B16F10 tumors.

TGFRt15-TGFRs treatment is capable of significantly increasing the number of NK and T cells in vivo. To determine if these immune cells were responsible for TGFRt15-TGFRs-mediated antitumor efficacy, Ab immunodepletion of CD8$^+$ T cells and NK1.1$^+$ cells was conducted in tumor-bearing mice prior to TGFRt15-TGFRs treatment. It was found that NK1.1$^+$ cell depletion (alone or in combination with CD8$^+$ T cell depletion) eliminated the antitumor effects of TGFRt15-TGFRs in B16F10 tumor-bearing mice during the first 2 weeks post-treatment (FIG. 252C), whereas either NK1.1$^+$ cell depletion or CD8$^+$ T cell depletion reduced the survival benefit seen with TGFRt15-TGFRs (FIG. 252D). Consistent with these findings, TGFRt15-TGFRs treatment also promoted an increase in NK cell and CD8$^+$ T cell infiltration into B16F10 tumors (FIG. 252E). These results support the conclusion that both CD8$^+$ T cells and NK cells play a major role in TGFRt15-TGFRs-mediated activity against melanoma tumor cells in C57BL/6 mice.

Example 118: TGFRt15-TGFRs Improved the Glucose Control in db/db Mice

Five-week-old male BKS.Cg-Dock7m+/+Leprdb/J (db/db) mice (Jackson Lab) were fed with standard chow diet and maintained in the standard conditions. Mice (n=5/group) were received subcutaneous injections of either PBS (control group) or TGFRt15-TGFRs (3 mg/kg) (treatment group) at weeks 6 and 12 from the start of the study. The fasting blood glucose and insulin were checked three weeks after the 1$^{st}$ dose. The fasting glucose was significantly reduced (FIG. 253A) after TGFRt15-TFGRs treatment compared to controls but blood insulin levels were not changed (FIG. 253B).

Example 119: TGFRt15-TGFRs Significantly Down-Regulated Aging Index and SASP Index Five-week-old male BKS.Cg-Dock7m+/+Leprdb/J (db/db) mice were fed with standard chow diet and received drinking water ad libitum. At the age of six weeks, mice were randomly assigned to control and treatment groups (n=5/group). The treatment group received TGFRt15-TGFRs by subcutaneous injection at 3 mg/kg at weeks 6 and 12 from the start of the study, while the control group received vehicle (PBS) only. At end of study (4-weeks post the 2$^{nd}$ dose), mice were euthanized and pancreas was collected. The half of pancreas was homogenized with the TRIzol reagent (Invitrogen) and total tissue RNA was purified with RNeasy Mini Kit (Qiagen). Synthesis of cDNA was performed using a QuantiTect Reverse Transcription Kit (Qiagen) and quantitative PCR was performed using a SsoAdvanced™ Universal SYBR® Green Supermix (BioRad) and a QuantiStudio 3 Real-Time PCR System (Applied Biosystems) according to comparative threshold cycle method following manufacturer's protocol. The amplification reactions were performed in duplicate, and the fluorescence curves were analyzed with the software included with the QuantiStudio 3 Real-Time PCR System. The housekeeping gene 18s ribosomal RNA was used as an endogenous control reference. The expression of each target mRNA relative to 18s rRNA was calculated based on Ct as $2^{-\Delta(\Delta Ct)}$, in which $\Delta Ct=Ct_{target}-Ct_{18S}$. As shown in FIG. 254A, TGFRt15-TGFRs treatment of db/db mice resulted in a reduction of pancreatic gene expression for p16, p21, Igfr1, and Bamb1 of the Aging gene index and IL-1α, IL-6, MCP-1, and TNFα of SASP gene index when compared to the control group. Generally, pancreatic expression of genes of the SASP Index and Aging Index were significantly reduced following TGFRt15-TGFRs treatment compared to controls, whereas pancreatic gene expression of the beta cell index was not changed significantly in the TGFRt15-TGFRs and PBS-treated db/db mice. (FIGS. 254B, 254C, 254D). The data suggested TGFRt15-TGFRs has potent senolytic and senomorphic activities to reduce senescent cells and SASP factors in the pancreas of db/db mice.

Example 120: TGFRt15-TGFRs Reduced Senescent Cells of Pancreatic Beta Cells

Five-week-old male BKS.Cg-Dock7m+/+Leprdb/J (db/db) mice (Jackson Lab) were fed with standard chow diet (Irradiated 2018 Teklad global 18% protein rodent diet, Envigo) and received drinking water ad libitum. At the age of six weeks, mice were randomly assigned to control and treatment groups (n=5/group). The treatment group received TGFRt15-TGFRs by subcutaneous injection at 3 mg/kg at weeks 6 and 12 from the start of the study, while control group received vehicle (PBS) only. At end of study (4-weeks post the 2n d dose), mice were euthanized and pancreata were removed en bloc, immersion-fixed in 4% formaldehyde (4% formaldehyde in 0.1M phosphate buffer; PBS pH 7.4) and stored at 4° C. degrees until further processing. Dissected pancreata were paraffinized, embedded, and sectioned, and three 10 mm sections (150 mm apart) were cut from each block representing in total a systematic uniform random sample of the whole pancreas from each animal.

Multispectral imaging was performed using the Akoya Vectra Polaris instrument. This instrumentation allows for phenotyping, quantification, and spatial relationship analysis of tissue infiltrate in formalin-fixed paraffin-imbedded biopsy sections. To quantify levels of p21 in insulin+islet regions of the pancreas, formalin-fixed paraffin-embedded tissue sections were stained consecutively with specific primary antibodies according to standard protocols provided by Akoya and performed routinely by the HIMSR. Briefly, the slides were deparaffinized, heat treated in antigen retrieval buffer, blocked, and incubated with rabbit primary antibodies against insulin (#4590, Cell Signaling Technology) and p21 (EPR362, Abcam), followed by horseradish peroxidase (HRP)-conjugated secondary antibody polymer (anti-rabbit), and HRP-reactive OPAL fluorescent reagents (OPAL-520 for insulin and OPAL-570 for p21, Akoya) that use TSA chemistry to deposit dyes on the tissue immediately surrounding each HRP molecule. To prevent further deposition of fluorescent dyes in subsequent staining steps, the slides were stripped in between each stain with heat treatment in antigen retrieval buffer (Citrate buffer for insulin and EDTA buffer for p21). Whole slide scans were collected with the Akoya Vectra Polaris instrument using the 20× objective with a 0.5 micron resolution. The 3 color images were analyzed with inForm software (Akoya) to unmix adjacent fluorochromes, subtract autofluorescence, segment insulin+ regions of the tissue, compare the frequency and location of cells, segment cellular cytoplasmic and nuclear regions, and phenotype infiltrating cells according to cell marker expression.

As shown in FIG. 255A-255D, p21 positive senescent cells (OPAL-570) were accumulated more in insulin positive islet beta cells (OPAL-520) in pancreas of control group (FIG. 255A) and these senescent cells were reduced in pancreas of TGFRt15-TGFRs treatment group (FIG. 255B). The insulin positive islet cells were significantly increased in TGFRt15-TGFRs treatment group compared with the control group (p=0.0278, FIG. 255C). The p21 positive senescent beta cells (insulin positive) were reduced in TGFRt15-TGFRs treated group compared with the control group though the difference was not statistically significant (FIG. 255D). Overall, the data suggested TGFR15-TGFRs has senolytic activity to remove senescent cells and promotes the recovery of normal functional islet beta cells in the pancreas of db/db mice.

Example 121: TGFRt15-TGFRs Reduced Senescent Cells of Pancreatic Beta Cells by Increasing NK, NKT, and CD8+ T Cells Five-week-old male BKS.Cg-Dock7m+/+Leprdb/J (db/db) mice (Jackson Lab) were fed with standard chow diet (Irradiated 2018 Teklad global 18% protein rodent diet, Envigo) and received drinking water ad libitum. At the age of six weeks, mice were randomly assigned into control and treatment groups (n=5/group). The treatment group received TGFRt15-TGFRs by subcutaneous injection at 3 mg/kg at weeks 6 and 12 from the start of the study, while control group received vehicle (PBS) only.

Four days after the 1st dose treatment, blood was collected and whole blood cells (50 mL) were treated with ACK (Ammonium-Chloride-Potassium) lysing buffer to lyse red blood cells. The lymphocytes were then stained with PE-Cy7-anti-CD3, BV605-anti-CD45, PerCP-Cy5.5-anti-CD8a, BV510-anti-CD4, and APC-anti-NKp46 antibodies (all antibodies from BioLegend) to assess the population of T cells, NKT cells, and NK cells. As shown in FIG. 256A-256C, the percentages of CD8+ T cells, CD3+NKP46+ NKT cells, and CD3−NKP46+ NK cells increased in the blood of db/db mice following treatment with TGFRt15-TGFRs compared to the PBS-treated mice.

Example 122: Phenotyping of Immune Cell Subsets in Peripheral Blood of Cynomolgus Monkeys Following Administration of TGFRt15-TGFRs Cynomolgus monkeys (5M:5F per group) were treated subcutaneously with PBS (vehicle) or TGFRt15-TGFRs at 1, 3 or 10 mg/kg on study days 1 and 15. Blood was collected pre-day (day 1) and days 5, 22 and 29 post-treatment. PBMCs were prepared and stained with a panel of fluor-conjugated antibodies to assess the phenotypes of B cells, NK cells, NK-T cells, Treg cells and CD4+ and CD8+ T cells by flow cytometry. FIG. 257 shows that TGFRt15-TGFRs administration resulted in a significant increase in the percentage of Ki67+ NK cells, NK-T cells, Treg cells and CD4+ and CD8+ T cells on day 5 post-treatment. These findings indicate that TGFRt15-TGFRs treatment induced proliferation of these lymphocyte subsets in non-human primates. No treatment effects were observed on Ki67 expression in B cells.

Example 123: IL-15 Immunostimulatory and TGF-β Antagonist Activities of TGFRt15-TGFRs Six-week-old (young) and 72-week-old (aged) C57BL/6 mice were subcutaneously injected with single dose of PBS, TGFRt15-TGFRs (3 mg/kg) or TGFRt15*-TGFRs (3 mg/kg). On day 4 after treatment, mice were sacrificed, and the spleens were harvested. The spleens were crushed with flat back end of the sterile piston/plunger of 3 cc syringe to release the splenocytes. The splenocytes were passed through a 70 µM cell strainer and homogenized into a single cell suspension. The RBCs were lysed in ACK lysis buffer and the splenocytes were washed and counted. To measure the glycolytic activity of the splenocytes, the cells were washed and resuspended in Seahorse media and resuspended at $4\times10^6$ cells/mL. Cells were seeded at 50 µL/well in Cell-Tak-coated Seahorse Bioanalyzer XFe96 culture plates in Seahorse XF RPMI medium, pH 7.4 supplemented with 2 mM L-glutamine for glycolysis stress test. The cells were allowed to attach to the plate for 30 min at 37° C. Additionally, 130 µL of the assay medium was added to each well of the plate (also the background wells). The plate was incubated in 37° C., non-CO$_2$ incubator for 1 hr. For glycolysis stress test the calibration plate contained 10× solution of glucose/oligomycin/2DG prepared in Seahorse assay media and 20 µL of glucose/oligomycin/2DG were added to each of the ports of the extracellular flux plate that was calibrated overnight. The glycolysis stress test is based on extracellular acidification rate (ECAR) and measures three key parameters of glycolytic function including glycolysis, glycolytic capacity and glycolytic reserve. Complete ECAR analysis consisted of four stages: non glycolytic acidification (without drugs), glycolysis (10 mM glucose), maximal glycolysis induction/glycolytic capacity (2 µM oligomycin), and glycolysis reserve (100 mM 2-DG). At the end of the experiment the data was exported as a Graph Pad Prism file. The XF glycolysis stress test report generator automatically calculated the XF cell glycolysis stress test parameters from the Wave data. The data was analyzed using the Wave software (Agilent).

As shown in FIG. 258, the splenocytes isolated from aged mice on day 4 after TGFRt15-TGFRs treatment showed enhanced basal glycolysis, glycolysis capacity, and glycolysis reserve rates, when compared to splenocytes of the PBS or TGFRt15*-TGFRs treatment groups. The glycolytic function of splenocytes of aged control mice was less than that of the young control mice. Treatment of young and aged mice with TGFRt15*-TGFRs was capable of increasing splenocyte glycolytic function. However, TGFRt15-TGFRs treatment of aged mice was able to increase the rates of splenocyte basal glycolysis, glycolysis capacity, and glycolysis reserve to levels equivalent to those observed in the splenocytes from TGFRt15-TGFRs treated young mice. These findings suggest that the IL-15 immunostimulatory and TGF-β antagonist activities of TGFRt15-TGFRs effectively stimulate and rejuvenate the diminished metabolic activity of immune cells from aged mice.

Six-week-old (young) and 72-week-old (aged) C57BL/6 mice were subcutaneously injected with single dose of PBS, TGFRt15-TGFRs (3 mg/kg) or TGFRt15*-TGFRs (3 mg/kg). On day 4 after treatment, mice were sacrificed, and the spleens were harvested. The spleens were crushed with flat back end of the sterile piston/plunger of 3 cc syringe to release the splenocytes. The splenocytes were passed through a 70 μM cell strainer and homogenized into a single cell suspension. The RBCs were lysed in ACK lysis buffer and the splenocytes were washed and counted. To measure the mitochondrial respiration of the splenocytes, the cells were washed and resuspended in Seahorse media and resuspended at $4 \times 10^6$ cells/mL. Cells were seeded at 50 μL/well in Cell-Tak-coated Seahorse Bioanalyzer XFe96 culture plates in Seahorse XF RPMI medium, pH 7.4 supplemented with 2 mM L-glutamine for glycolysis stress test. For mitochondrial stress test, the cells were seeded in Seahorse XF RPMI medium, pH 7.4 supplemented with 10 mM glucose and 2 mM L-glutamine. The cells were allowed to attach to the plate for 30 mM at 37° C. Additionally, 130 μl, of the assay medium was added to each well of the plate (also the background wells). The plate was incubated in 37° C., non-$CO_2$ incubator for 1 hr. For mitochondrial stress test, the calibration plate contained 10× solution of oligomycin/FCCP/rotenone prepared in Seahorse assay media and 20 μL of oligomycin, FCCP and rotenone was added to each of the ports of the extracellular flux plate that was calibrated overnight. Oxygen consumption rate (OCR) was measured using an XFe96 Extracellular Flux Analyzer. Complete OCR analysis consisted of four stages: basal respiration (without drugs), ATP-linked respiration/Proton leak (1.5 μM oligomycin), maximal respiration (2 μM FCCP), and spare respiration (0.5 μM rotenone). At the end of the experiment, the data was exported as a Graph Pad Prism file. The XF mitochondrial stress test report generator automatically calculates the XF mitochondrial stress test parameters from the Wave data that have been exported to Excel. The data was analyzed by using the Wave software (Agilent).

As shown in FIG. 259, the splenocytes isolated from aged mice on day 4 after TGFRt15-TGFRs therapy showed enhanced basal respiration, ATP-linked respiration, maximal respiration, and reserve capacity, when compared to splenocytes of the PBS or TGFRt15*-TGFRs treatment groups. Treatment of young and aged mice with TGFRt15*-TGFRs was capable of increasing splenocyte mitochondrial respiration. However, TGFRt15-TGFRs treatment in aged mice able to increase the rates of basal respiration, ATP-linked respiration, maximal respiration, and reserve capacity to levels equivalent or higher to those observed in the splenocytes from TGFRt15-TGFRs treated young mice. These findings suggest that the IL-15 immunostimulatory and TGF-β antagonist activities of TGFRt15-TGFRs effectively stimulate and rejuvenate the diminished metabolic activity of immune cells from aged mice.

Example 124: IL-15 Activity of TGFRt15-TGFRs Plays a Role in Increasing $CD8^+$ T Cells and NK Cells Six-week-old (young) and 72-week-old (aged) C57BL/6 mice were purchased from the Jackson Laboratory. Mice were housed in a temperature and light controlled environment. Mice (n=6/group) were treated subcutaneously with PBS, TGFRt15-TGFRs (3 mg/kg) and TGFRt15*-TGFRs (3 mg/kg). The mouse blood was collected from submandibular vein on day 4 post treatment in tubes containing EDTA to evaluate changes in the different subsets of immune cells. Whole blood RBCs were lysed in ACK buffer for 5 minutes at room temperature. Remaining cells were washed in FACS buffer (1×PBS (Hyclone) with 0.5% BSA (EMD Millipore) and 0.001% sodium azide (Sigma)). To assess the different types of immune cells in blood, cells were stained with antibodies specific to cell-surface CD3, CD4, CD45, CD8 and NK1.1 (BioLegend) for 30 min at room temperature (RT). After surface staining, cells were washed (1500 RPM for 5 min at RT) in FACS buffer (1×PBS (Hyclone) with 0.5% BSA (EMD Millipore) and 0.001% sodium azide (Sigma)). After two washes, cells were resuspended in fixation buffer and analyzed by flow cytometry (Celesta-BD Bioscience).

As shown in FIG. 260, the results indicate that treatment of aged mice with TGFRt15-TGFRs induced an increase in the percentages of $CD3^+CD45^+$, $CD3^+CD8^+$, and $CD3^-NK1.1^+$ immune cells in the blood, whereas treatment of aged mice with TGFRt15*-TGFRs had no effect on the percentage of these blood cell populations. These results suggest that IL-15 activity of TGFRt15-TGFRs plays a role in increasing $CD8^+$ T cells and NK cells in the blood of aged mice. The percentage of blood T cells and NK cells in aged control mice was less than that of the young control mice. However, treatment of aged mice with TGFRt15-TGFRs increased the percentages of $CD3^+CD45^+$, $CD3^+CD8^+$, and $CD3^-NK1.1^+$ immune cells in the blood to levels similar to those observed in the blood of TGFRt15-TGFRs treated young mice.

Six-week-old (young) and 72-week-old (aged) C57BL/6 mice were purchased from the Jackson Laboratory. Mice were housed in a temperature and light controlled environment. Mice (n=6/group) were treated subcutaneously with PBS, TGFRt15-TGFRs (3 mg/kg) and TGFRt15*-TGFRs (3 mg/kg). Four days after treatment, the mice were euthanized, and spleen was harvested and processed to a single cell suspension. Single cells suspension was prepared in order to evaluate the different subsets of immune cells. RBCs were lysed in ACK buffer for 5 min at room temperature. The remaining cells were washed in FACS buffer (1×PBS (Hyclone) with 0.5% BSA (EMD Millipore) and 0.001% sodium azide (Sigma)). To assess the different types of immune cells in spleen, cells were stained with antibodies specific to cell-surface CD3, CD45, CD8 and NK1.1 (BioLegend) for 30 minutes at RT. After surface staining, cells were washed (1500 RPM for 5 min at room temperature) in FACS buffer (1×PBS (Hyclone) with 0.5% BSA (EMD Millipore) and 0.001% sodium azide (Sigma)). After two washes, cells were resuspended in fixation buffer and analyzed by flow cytometry (Celesta-BD Bioscience).

As shown in FIG. 261, the results indicate that treatment of aged mice with TGFRt15-TGFRs induced an increase in the percentages of CD3$^+$CD45$^+$, CD3$^+$CD8$^+$, and CD3$^-$NK1.1$^+$ immune cells in the spleen, whereas treatment of aged mice with TGFRt15*-TGFRs had no effect on the percentage of these splenocyte populations. These results suggest that IL-15 activity of TGFRt15-TGFRs plays a role in increasing CD8$^+$ T cells and NK cells in the blood of aged mice. The percentage of spleen T cells and NK cells in aged control mice was less than that of the young control mice. However, treatment of aged mice with TGFRt15-TGFRs increased the percentages of CD3$^+$CD45$^+$, CD3$^+$CD8$^+$, and CD3$^-$NK1.1$^+$ immune cells in the spleen to levels similar to those observed in the spleen of TGFRt15-TGFRs treated young mice.

Example 125: TGFRt15-TGFRs-Associated Decrease in Naturally-Occurring Senescent Cells in the Liver Seventy-two-week-old (aged) C57BL/6 mice were purchased from the Jackson Laboratory. Mice were housed in a temperature and light controlled environment. Mice (n=8/group) were treated subcutaneously with either PBS or one dose or two doses (at day 0 and 60) of TGFRt15-TGFRs (3 mg/kg). On day 71 post treatment, mice were euthanized and the livers were harvested and stored in liquid nitrogen in 1.7 mL Eppendorf tubes. Tissue samples were homogenized by using homogenizer in 1 mL of Trizol (Thermo Fischer). Homogenized tissues were transferred in fresh Eppendorf tubes and total RNA was extracted using RNeasy Mini Kit (Qiagen #74106) according to the manufacturer's instructions. One μg of total RNA was used for cDNA synthesis using the QuantiTect Reverse Transcription Kit (Qiagen). Real-time PCR was carried out with CFX96 Detection System (Bio-Rad) using FAM labeled predesigned primers purchased from Thermo Scientific. Reactions were run in triplicate for all the genes examined. The housekeeping gene 18S ribosomal RNA was used as an internal control to normalize the variability in gene expression levels. The expression of each target mRNA relative to 18S rRNA was calculated based on Ct as $2^{-\Delta(\Delta Ct)}$, in which $\Delta Ct=Ct_{target}-Ct_{18S}$. Untreated 6-week-old mice were used as a control to compare the gene expression level to aged mice. The results showed that gene expression of IL-1α, IL-1β, IL-6, p21 and PAI-1 in liver increased with the age of the mice as expected with the age-dependent increase in cellular senescence-associated transcripts. Treatment of 72-week-old mice with a single dose or two doses of TGFRt15-TGFRs resulted in a significant reduction in gene expression of senescence markers IL-1α, IL-1β, IL-6, p21 and PAI-1 in liver when compared to the PBS control group (FIG. 262). These findings suggest a TGFRt15-TGFRs-associated decrease in naturally-occurring senescent cells in the liver of aged mice.

Example 126: TGFRt15-TGFRs Treatment is Capable of Reducing Inflammation in Liver Tissues Seventy-two-week-old (aged) C57BL/6 mice were purchased from the Jackson Laboratory. Mice were housed in a temperature and light controlled environment. Mice (n=10/group) were treated subcutaneously with either PBS or one or two doses of TGFRt15-TGFRs (3 mg/kg). On day 120 after treatment, mice were euthanized and the mouse liver was prepared to evaluate by histochemistry. Liver tissue specimens were fixed in 10% formaldehyde and after a paraffin blocking procedure, cross-sections were stained with hematoxylin-eosin. The extent of liver injury was evaluated histologically in a blinded manner. Histological sections of whole liver areas were scores for inflammation using a scale from 0 to 4 (0, absent and appearing to be normal; 1, light; 2, moderate; 3, strong; and 4, intense). As shown in FIG. 263, two doses of TGFRt15-TGFRs decrease the liver inflammation score in liver of aged mice compared to single dose TGFRt15-TGFRs or PBS control groups. These results suggest that TGFRt15-TGFRs treatment is capable of reducing inflammation in liver tissues of aged mice.

Example 127: TGFRt15-TGFRs Treatment can Reduce IL1-α, IL-6, IL-8, PAI-1 and Fibronectin Protein Levels Seventy-two-week-old (aged) C57BL/6 mice were purchased from the Jackson Laboratory. Mice were housed in a temperature and light controlled environment. Mice (n=10/group) were treated with either PBS or one dose or two doses (at day 0 and 60) of TGFRt15-TGFRs (3 mg/kg). On day 120 after treatment, mice were euthanized and liver were harvested and stored in liquid nitrogen in 1.7 mL Eppendorf tubes. Tissue samples were homogenized by using homogenizer in 0.3 mL of extraction buffer (Abcam). Homogenized tissues were transferred in fresh Eppendorf tubes. Protein levels in homogenized tissue were quantified using BCA Protein Assay Kit (Pierce). An ELISA to detect IL-1α, IL-1β, IL-6, IL-8, TGF-β, PAI-1, collagen and fibronectin (R&D System) was performed using 25 μg of tissue homogenize. As shown in FIG. 264, protein levels of IL-1α, IL-6, IL-8, PAI-1 and fibronectin were reduced in liver of mice treated with 2 doses of TGFRt15-TGFRs compared to PBS control or one dose TGFRt15-TGFRs treatment groups. These results indicate that 2 doses of TGFRt15-TGFRs treatment can reduce IL-1α, IL-6, IL-8, PAI-1 and fibronectin protein levels in liver of aged mice. Protein levels of IL-1β, TGF-β and collagen were also lower in liver of mice treated with 2 doses of TGFRt15-TGFRs compared to PBS controls; however, these changes did not reach statistical significance.

Example 128: TGFRt15-TGFRs Reduces Senescence Cells

Seventy-two-week-old (aged) C57BL/6 aged mice which were purchased from the Jackson Laboratory. Mice were housed in a temperature and light controlled environment. Mice (n=5/group) were treated subcutaneously with either PBS or TGFRt15-TGFRs (3 mg/kg). On day 4 after treatment, mice were euthanized and livers were harvested, homogenized in PBS containing 2% FBS, and filtered in 70-micron filter to obtain a single cell suspension. Cells were spun down then resuspended in 5 mL RPMI containing 0.5 mg/mL collagenase IV and 0.02 mg/mL DNAse in 14 mL round bottom tubes. Cells were then shaken on orbital shaker for 1 hr at 37° C. and washed twice with RPMI. Cells were resuspended at 2×10$^6$/mL in 24 wells flat bottom plate in 2 mL of complete media (RPMI 1640 (Gibco) supplemented with 2 mM L-glutamine (Thermo Life Technologies), penicillin (Thermo Life Technologies), streptomycin (Thermo Life Technologies), and 10% FBS (Hyclone)) and cultured for 48 hr at 37° C., 5% CO$_2$. Cells were harvested, washed once in warm complete media at 1000 rpm for 10 minutes at room temperature. Cell pellet was resuspended in 500 µL of fresh media containing 1.5 µL of Senescence Dye per tube (Abcam). Cells were further incubated for 1-2 hr at 37° C., 5% $CO_2$ and wash twice with 500 µL wash buffer. Cell pellet was resuspended in 500 µL of wash buffer and was analyzed immediately by flow cytometry (Celesta-BD Bioscience). As shown in FIG. 265, the percentage of senescence marker β-gal$^+$ cells were decreased 4 days after in vivo treatment with TGFRt15-TGFR. These results demonstrate that TGFRt15-TGFRs is capable of reducing senescence cells (based on the β-gal marker) in liver of aged mice.

Example 129: Effects of TGFRt15-TGFRs on Survival of Aged Mice

Seventy-two-week-old C57BL/6 mice were purchased from the Jackson Laboratory. Mice were housed in a temperature and light controlled environment. Mice were treated subcutaneously with either PBS or one dose of TGFRt15-TGFRs (3 mg/kg) (n=20/group). Mice were monitored every day for survival up to 120 weeks post treatment. The survival probability of the treatment groups based on the Mantel-Cox log-rank test is shown in FIG. 266. Compared with TGFRt15-TGFRs, higher mortality rates were found in control mice which was represented by a decline in the survival rates of the mice. By week 120 post treatment, there was a 70% mortality rate in PBS control mice compared to a 45% mortality rate in the TGFRt15-TGFRs-treated mice.

Example 130: Effects of TGFRt15-TGFRs in Reducing SASP Factors in Liver of B16F10 Tumor-Bearing Mice Following Chemotherapy The effects of TGFRt15-TGFRs treatment in reducing protein levels of SASP factors in B16F10 tumor-bearing mice following chemotherapy were further assessed. B16F10 tumor cells ($1 \times 10^7$ cells/mouse) were implanted in mice on day 0. The mice were treated subcutaneously with 10 mg/kg docetaxel on days 1, 4, and 7. On day 8, the mice were treated subcutaneously with PBS or TGFRt15-TGFRs (3 mg/kg). Mice were euthanized on day 17 post-tumor inoculation and livers were collected and homogenized. Protein levels of SASP factors in the liver homogenates was determined by ELISA. As shown in FIG. 267, in vivo treatment with TGFRt15-TGFRs resulted in a significant reduction in levels of liver IL-1α, IL-6, TNFα and IL-8 SASP factors in B16F10 tumor bearing mice following chemotherapy.

Example 131: Role of Immune Cell Subsets in TGFRt15-TGFRs-Mediated Elimination of Senescent Tumor Cells in B16F10 Melanoma Mouse Model To assess the role of immune cell subsets in TGERt15-TGFRs-mediated senescent-tumor-cell elimination, in vitro-docetaxel induced senescent B16F10-GFP tumor cells were mixed with parental B16F10 cells were implanted subcutaneously in mice following treatment with anti-NK1.1 or anti-CD8a antibodies. When tumors reached to approximately 350 mm$^3$, mice were randomized to receive subcutaneous treatment with PBS or TGFRt15-TGFRs (3 mg/kg)+ TA99 (200 µg). The mice were sacrificed day 4 post-therapy and tumors were collected and analyzed. The level of GFP-positive B16F10-GFP TIS cells and NK and CD8$^+$ T cells in the tumors were assess by flow cytometry. As shown in FIG. 268A, TGFRt15-TGFRs-treated mixed tumors without immunodepletion or depleted for CD8$^+$ T immune cells contained significantly fewer GFP-expressing senescence tumor cells than that of control treated mice. It was also observed that the tumors of CD8$^+$ depleted mice were significantly infiltrated with NK cells and tumors of NK depleted mice were significantly infiltrated with CD8$^+$ T cells (FIG. 268B). These results suggested that both NK and CD8$^+$ T cells play a role in controlling tumor growth with NK cells predominately mediating the activity of TGFRt15-TGFRs to deplete TIS tumor cells.

Example 132: Anti-PD-Li Antibody in Combination with TGFRt15-TGFRs+TA99 and Chemotherapy in B16F10 Melanoma Mouse Model To further assess a sequential TGFRt15-TGFRs-immune checkpoint inhibitor treatment regimen (described in Example 109), B16F10 tumor-bearing mice were first treated with doxetaxel (DTX) and then either TGFRt15-TGFRs+TA99 followed by anti-PD-L1 antibody or anti-PD-L1 antibody followed by TGFRt15-TGFRs+TA99 (FIG. 269A). Tumor growth curves and end point tumor volume at day 18 indicated that both combination strategies (TGFRt15-TGFRs+TA99 followed by anti-PD-L1 and vice versa) showed significant tumor volume reduction as compared to the individual immunotherapies (either TGFRt15-TGFRs+TA99 or anti PD-L1 alone) or DTX alone (FIG. 269B). Interestingly, TGFRt15-TGFRs+TA99-treated tumors showed significantly lower tumor volume at day 13 prior to start of combination treatments as compared to anti-PD-L1-treated tumors, showing the effect of TGFRt15-TGFRs+TA99 in initial control of tumor growth. End point analysis also showed that tumors treated with the combination of TGFRt15-TGFRs+TA99 and anti-PD-L1 antibody led to significantly increased levels of tumor infiltrating CD8$^+$ T cells and NK cells as compared to single treatment groups. Combination treatment increased the expression of costimulatory receptor CD28 on CD8$^+$ TILs compared to single treatment suggesting that checkpoint blockade could rescue dysfunctional CD8$^+$ TILs that are further activated by IL-15 activity of TGFRt15-TGFRs within the tumor microenvironment (FIG. 269C). This was concomitant with enhanced activation phenotype (IFNγ secretion) of splenic CD8$^+$ T cells from combination treatment group following stimulation with PMA/ionomycin (FIG. 269D). Combination treatment also showed increased NKG2D expression on total CD8$^+$ T cells and CD44$^{hi}$ CD8$^+$ T cells in the tumors compared to the individual immunotherapy treatment (FIG. 269E). These data collectively shows that combination therapy of TGFRt15-TGFRs+TA99 and anti-PD-L1 antibody led to activation and infiltration of CD8$^+$ T cells that may contributed to effective tumor control.

Example 133: Antitumor Efficacy of TGFRt15-TGFRs in Combination with Chemotherapy Against SW1990 Human Pancreatic Tumors in C57BL/6 SCID Mice To further assess the anti-tumor activity of TGFRt15-TGFRs in combination with chemotherapy, SW1990 human pancreatic cancer cells ($2 \times 10^6$ cells/mouse) were subcutaneously (s.c.) injected into C57BL/6 scid mice. Nine days after tumor cell implantation, gemcitabine (40 mg/kg, i.p.) and nab-paclitaxel (Abraxane) (5 mg/kg, i.p.) chemotherapy was initiated followed 2 days later by TGFRt15-TGFRs (3 mg/kg, s.c.). This was considered one treatment cycle and was repeated for another 3 cycles (1 cycle/week) (FIG.

270A). Tumor-bearing control groups received PBS, chemotherapy, or TGFRt15-TGFRs treatment alone. During and after the study treatment, tumor volumes were measured and animal survival based on tumor volume <4000 mm$^3$ was assessed. The results indicated that the animals receiving a combination of TGFRt15-TGFRs and chemotherapy had significantly slower SW1990 tumor growth comparing to the PBS group (FIG. 270B-270C). TGFRt15-TGFRs+chemotherapy also prolonged survival of SW1990 tumor-bearing mice (FIG. 270D). These results confirm that TGFRt15-TGFRs enhanced the efficacy of standard of care chemotherapy against human pancreatic tumors in a mouse xenograft tumor model.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

Exemplary Embodiments

Embodiment A1. A single-chain chimeric polypeptide comprising:
(i) a first target-binding domain;
(ii) a soluble tissue factor domain; and
(iii) a second target-binding domain.

Embodiment A2. The single-chain chimeric polypeptide of embodiment A1, wherein the first target-binding domain and the soluble tissue factor domain directly abut each other.

Embodiment A3. The single-chain chimeric polypeptide of embodiment A1, wherein the single-chain chimeric polypeptide further comprises a linker sequence between the first target-binding domain and the soluble tissue factor domain.

Embodiment A4. The single-chain chimeric polypeptide of any one of embodiments A1-A3, wherein the soluble tissue factor domain and the second target-binding domain directly abut each other.

Embodiment A5. The single-chain chimeric polypeptide of any one of embodiments A1-A3, wherein the single-chain chimeric polypeptide further comprises a linker sequence between the soluble tissue factor domain and the second target-binding domain.

Embodiment A6. The single-chain chimeric polypeptide of embodiment A1, wherein the first target-binding domain and the second target-binding domain directly abut each other.

Embodiment A7. The single-chain chimeric polypeptide of embodiment A1, wherein the single-chain chimeric polypeptide further comprises a linker sequence between the first target-binding domain and the second target-binding domain.

Embodiment A8. The single-chain chimeric polypeptide of embodiment A6 or A7, wherein the second target-binding domain and the soluble tissue factor domain directly abut each other.

Embodiment A9. The single-chain chimeric polypeptide of embodiment A6 or A7, wherein the single-chain chimeric polypeptide further comprises a linker sequence between the second target-binding domain and the soluble tissue factor domain.

Embodiment A10. The single-chain chimeric polypeptide of any one of embodiments A1-A9, wherein the first target-binding domain and the second target-binding domain bind specifically to the same antigen.

Embodiment A11. The single-chain chimeric polypeptide of embodiment A10, wherein the first target-binding domain and the second target-binding domain bind specifically to the same epitope.

Embodiment A12. The single-chain chimeric polypeptide of embodiment A11, wherein the first target-binding domain and the second target-binding domain comprise the same amino acid sequence.

Embodiment A13. The single-chain chimeric polypeptide of any one of embodiments A1-A9, wherein the first target-binding domain and the second target-binding domain bind specifically to different antigens.

Embodiment A14. The single-chain chimeric polypeptide of any one of embodiments A1-A13, wherein one or both of the first target-binding domain and the second target-binding domain is an antigen-binding domain.

Embodiment A15. The single-chain chimeric polypeptide of embodiment A14, wherein the first target-binding domain and the second target-binding domain are each an antigen-binding domain.

Embodiment A16. The single-chain chimeric polypeptide of embodiment A13, wherein antigen-binding domain comprises a scFv or a single domain antibody.

Embodiment A17. The single-chain chimeric polypeptide of any one of embodiments A1-A16, wherein one or both of the first target-binding domain and the second target-binding domain bind to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-D, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, a receptor for CD122, and a receptor for CD28.

Embodiment A18. The single-chain chimeric polypeptide of any one of embodiments A1-A16, wherein one or both of the first target-binding domain and the second target-binding domain is a soluble interleukin or cytokine protein.

Embodiment A19. The single-chain chimeric polypeptide of embodiment A18, wherein the soluble interleukin, cytokine, or ligand protein is selected from the group consisting of: IL-1, IL-2, IL-3, IL-7, IL-8, IL-10, IL-12, IL-15, IL-17, IL-18, IL-21, PDGF-D, and SCF, FLT3L, MICA, MICB, and a ULP16-binding protein.

Embodiment A20. The single-chain chimeric polypeptide of any one of embodiments A1-A16, wherein one or both of the first target-binding domain and the second target-binding domain is a soluble interleukin or cytokine receptor.

Embodiment A21. The single-chain chimeric polypeptide of embodiment A20, wherein the soluble interleukin or cytokine receptor is a soluble TGF-β receptor II (TGF- (3RII), a soluble TGF-βRIII, a soluble NKG2D, a soluble NKp30, a soluble NKp44, a soluble NKp46, a soluble DNAM1, a scMHCI, a scMHCII, a scTCR, a soluble CD155, or a soluble CD28.

Embodiment A22. The single-chain chimeric polypeptide of any one of embodiments A1-A21, wherein the soluble tissue factor domain is a soluble human tissue factor domain.

Embodiment A23. The single-chain chimeric polypeptide of embodiment A22, wherein the soluble human tissue factor domain comprises a sequence that is at least 80% identical to SEQ ID NO: 93.

Embodiment A24. The single-chain chimeric polypeptide of embodiment A23, wherein the soluble human tissue factor domain comprises a sequence that is at least 90% identical to SEQ ID NO: 93.

Embodiment A25. The single-chain chimeric polypeptide of embodiment A24, wherein the soluble human tissue factor domain comprises a sequence that is at least 95% identical to SEQ ID NO: 93.

Embodiment A26. The single-chain chimeric polypeptide of any one of embodiments A22-A25, wherein the soluble human tissue factor domain does not comprise one or more of:
a lysine at an amino acid position that corresponds to amino acid position 20 of mature wildtype human tissue factor protein;
an isoleucine at an amino acid position that corresponds to amino acid position 22 of mature wildtype human tissue factor protein;
a tryptophan at an amino acid position that corresponds to amino acid position 45 of mature wildtype human tissue factor protein;
an aspartic acid at an amino acid position that corresponds to amino acid position 58 of mature wildtype human tissue factor protein;
a tyrosine at an amino acid position that corresponds to amino acid position 94 of mature wildtype human tissue factor protein;
an arginine at an amino acid position that corresponds to amino acid position 135 of mature wildtype human tissue factor protein; and
a phenylalanine at an amino acid position that corresponds to amino acid position 140 of mature wildtype human tissue factor protein.

Embodiment A27. The single-chain chimeric polypeptide of embodiment A26, wherein the soluble human tissue factor domain does not comprise any of:
a lysine at an amino acid position that corresponds to amino acid position 20 of mature wildtype human tissue factor protein;
an isoleucine at an amino acid position that corresponds to amino acid position 22 of mature wildtype human tissue factor protein;
a tryptophan at an amino acid position that corresponds to amino acid position 45 of mature wildtype human tissue factor protein;
an aspartic acid at an amino acid position that corresponds to amino acid position 58 of mature wildtype human tissue factor protein;
a tyrosine at an amino acid position that corresponds to amino acid position 94 of mature wildtype human tissue factor protein;
an arginine at an amino acid position that corresponds to amino acid position 135 of mature wildtype human tissue factor protein; and
a phenylalanine at an amino acid position that corresponds to amino acid position 140 of mature wildtype human tissue factor protein.

Embodiment A28. The single-chain chimeric polypeptide of any one of embodiments A1-A27, wherein the soluble tissue factor domain is not capable of binding Factor VIIa.

Embodiment A29. The single-chain chimeric polypeptide of any one of embodiments A1-A28, wherein the soluble tissue factor domain does not convert inactive Factor X into Factor Xa.

Embodiment A30. The single-chain chimeric polypeptide of any one of embodiments A1-A29, wherein the single-chain chimeric polypeptide does not stimulate blood coagulation in a mammal.

Embodiment A31. The single-chain chimeric polypeptide of any one of embodiments A1-A30, wherein the single-chain chimeric polypeptide further comprises one or more additional target-binding domains at its N- and/or C-terminus.

Embodiment A32. The single-chain chimeric polypeptide of embodiment A31, wherein the single-chain chimeric polypeptide comprises one or more additional target-binding domains at its N-terminus.

Embodiment A33. The single-chain chimeric polypeptide of embodiment A32, wherein one or more additional target-binding domains directly abuts the first target-binding domain, the second target-binding domain, or the soluble tissue factor domain.

Embodiment A34. The single-chain chimeric polypeptide of embodiment A33, wherein the single-chain chimeric polypeptide further comprises a linker sequence between one of the at least one additional target-binding domains and the first target-binding domain, the second target-binding domain, or the soluble tissue factor domain.

Embodiment A35. The single-chain chimeric polypeptide of embodiment A31, wherein the single-chain chimeric polypeptide comprises one or more additional target-binding domains at its C-terminus.

Embodiment A36. The single-chain chimeric polypeptide of embodiment A35, wherein one of the one or more additional target-binding domains directly abuts the first target-binding domain, the second target-binding domain, or the soluble tissue factor domain.

Embodiment A37. The single-chain chimeric polypeptide of embodiment A35, wherein the single-chain chimeric polypeptide further comprises a linker sequence between one of the at least one additional target-binding domains and the first target-binding domain, the second target-binding domain, or the soluble tissue factor domain.

Embodiment A38. The single-chain chimeric polypeptide of embodiment A31, wherein the single-chain chimeric polypeptide comprises one or more additional target binding domains at its N-terminus and the C-terminus.

Embodiment A39. The single-chain chimeric polypeptide of embodiment A38, wherein one of the one or more additional antigen binding domains at the N-terminus directly abuts the first target-binding domain, the second target-binding domain, or the soluble tissue factor domain.

Embodiment A40. The single-chain chimeric polypeptide of embodiment A38, wherein the single-chain chimeric polypeptide further comprises a linker sequence between one of the one or more additional antigen-binding domains at the N-terminus and the first target-binding domain, the second target-binding domain, or the soluble tissue factor domain.

Embodiment A41. The single-chain chimeric polypeptide of embodiment A38, wherein one of the one or more additional antigen binding domains at the C-terminus directly abuts the first target-binding domain, the second target-binding domain, or the soluble tissue factor domain.

Embodiment A42. The single-chain chimeric polypeptide of embodiment A38, wherein the single-chain chimeric polypeptide further comprises a linker sequence between one of the one or more additional antigen-binding domains at the C-terminus and the first target-binding domain, the second target-binding domain, or the soluble tissue factor domain.

Embodiment A43. The single-chain chimeric polypeptide of any one of embodiments A31-A42, wherein two or more of the first target-binding domain, the second target-binding domain, and the one or more additional target-binding domains bind specifically to the same antigen.

Embodiment A44. The single-chain chimeric polypeptide of embodiment A43, wherein two or more of the first target-binding domain, the second target-binding domain, and the one or more additional target-binding domains bind specifically to the same epitope.

Embodiment A45. The single-chain chimeric polypeptide of embodiment A44, wherein two or more of the first target-binding domain, the second target-binding domain, and the one or more additional target-binding domains comprise the same amino acid sequence.

Embodiment A46. The single-chain chimeric polypeptide of embodiment A43, wherein the first target-binding domain, the second target-binding domain, and the one or more additional target-binding domains each bind specifically to the same antigen.

Embodiment A47. The single-chain chimeric polypeptide of embodiment A46, wherein the first target-binding domain, the second target-binding domain, and the one or more additional target-binding domains each bind specifically to the same epitope.

Embodiment A48. The single-chain chimeric polypeptide of embodiment A47, wherein the first target-binding domain, the second target-binding domain, and the one or more additional target-binding domains each comprise the same amino acid sequence.

Embodiment A49. The single-chain chimeric polypeptide of any one of embodiments A31-A42, wherein the first target-binding domain, the second target-binding domain, and the one or more additional target-binding domains bind specifically to different antigens.

Embodiment A50. The single-chain chimeric polypeptide of any one of embodiments A31-A49, wherein one or more of the first target-binding domain, the second target-binding domain, and the one or more target-binding domains is an antigen-binding domain.

Embodiment A51. The single-chain chimeric polypeptide of embodiment A50, wherein the first target-binding domain, the second target-binding domain, and the one or more additional target-binding domains are each an antigen-binding domain.

Embodiment A52. The single-chain chimeric polypeptide of embodiment A51, wherein antigen-binding domain comprises a scFv or a single domain antibody.

Embodiment A53. The single-chain chimeric polypeptide of any one of embodiments A31-A52, wherein one or more of the first target-binding domain, the second target-binding domain, and the one or more target-binding domains bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-D, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, a receptor for CD122, and a receptor for CD28.

Embodiment A54. The single-chain chimeric polypeptide of any one of embodiments A31-A52, wherein one or more of the first target-binding domain, the second target-binding domain, and the one or more additional target-binding domains is a soluble interleukin or cytokine protein.

Embodiment A55. The single-chain chimeric polypeptide of embodiment A54, wherein the soluble interleukin, cytokine, or ligand protein is selected from the group consisting of: IL-1, IL-2, IL-3, IL-7, IL-8, IL-10, IL-12, IL-15, IL-17, IL-18, IL-21, PDGF-D, and SCF, FLT3L, MICA, MICB, and a ULP16-binding protein.

Embodiment A56. The single-chain chimeric polypeptide of any one of embodiments A31-A52, wherein one or more of the first target-binding domain, the second target-binding domain, and the one or more additional target-binding domains is a soluble interleukin or cytokine receptor.

Embodiment A57. The single-chain chimeric polypeptide of embodiment A56, wherein the soluble receptor is a soluble TGF-β receptor II (TGF-βRII), a soluble TGF-βRIII, a soluble NKG2D, a soluble NKp30, a soluble NKp44, a soluble NKp46, a soluble DNAM1, a scMHCI, a scMHCII, a scTCR, a soluble CD155, a soluble CD122, a soluble CD3, or a soluble CD28.

Embodiment A58. The single-chain chimeric polypeptide of any one of embodiments A1-A57, wherein the single-chain chimeric polypeptide further comprises a signal sequence at its N-terminal end.

Embodiment A59. The single-chain chimeric polypeptide of any one of embodiments A1-A58, wherein the single-chain chimeric polypeptide further comprises a peptide tag positioned at the N-terminal end or the C-terminal end of the single-chain chimeric polypeptide.

Embodiment A60. A composition comprising any of the single-chain chimeric polypeptides of embodiments A1-A59.

Embodiment A61. The composition of embodiment A60, wherein the composition is a pharmaceutical composition.

Embodiment A62. A kit comprising at least one dose of the composition of embodiment A60 or A61.

Embodiment A63. Nucleic acid encoding any of the single-chain chimeric polypeptides of any one of embodiments A1-A59.

Embodiment A64. A vector comprising the nucleic acid of embodiment A63.

Embodiment A65. The vector of embodiment A64, wherein the vector is an expression vector.

Embodiment A66. A cell comprising the nucleic acid of embodiment A63 or the vector of embodiment A64 or A65.

Embodiment A67. A method of producing a single-chain chimeric polypeptide, the method comprising:

culturing the cell of embodiment A66 in a culture medium under conditions sufficient to result in the production of the single-chain chimeric polypeptide; and recovering the single-chain chimeric polypeptide from the cell and/or the culture medium.

Embodiment A68. A single-chain chimeric polypeptide produced by the method of embodiment A67.

Embodiment A69. The single-chain chimeric polypeptide of embodiment A26, wherein the soluble human tissue factor domain comprises a sequence that is at least 80% identical to SEQ ID NO: 97.

Embodiment A70. The single-chain chimeric polypeptide of embodiment A69, wherein the soluble human tissue factor domain comprises a sequence that is at least 90% identical to SEQ ID NO: 97.

Embodiment A71. The single-chain chimeric polypeptide of embodiment A70, wherein the soluble human tissue factor domain comprises a sequence that is at least 95% identical to SEQ ID NO: 97.

Embodiment A72. The single-chain chimeric polypeptide of embodiment A71, wherein the soluble human tissue factor domain comprises a sequence that is 100% identical to SEQ ID NO: 97.

Embodiment A73. The single-chain chimeric polypeptide of embodiment A26, wherein the soluble human tissue factor domain comprises a sequence that is at least 80% identical to SEQ ID NO: 98.

Embodiment A74. The single-chain chimeric polypeptide of embodiment A73, wherein the soluble human tissue factor domain comprises a sequence that is at least 90%

Embodiment A75. The single-chain chimeric polypeptide of embodiment A74, wherein the soluble human tissue factor domain comprises a sequence that is at least 95% identical to SEQ ID NO: 98.

Embodiment A76. The single-chain chimeric polypeptide of embodiment A75, wherein the soluble human tissue factor domain comprises a sequence that is 100% identical to SEQ ID NO: 98.

Embodiment B1. A single-chain chimeric polypeptide comprising:
  (i) a first target-binding domain;
  (ii) a soluble tissue factor domain; and
  (iii) a second target-binding domain,
  wherein:
  the first target-binding domain and the second target-binding domain each specifically bind to an IL-2 receptor; or
  the first target-binding domain and the second target-binding domain each specifically bind to an IL-15 receptor.

Embodiment B2. The single-chain chimeric polypeptide of embodiment B1, wherein the first target-binding domain and the soluble tissue factor domain directly abut each other.

Embodiment B3. The single-chain chimeric polypeptide of embodiment B1, wherein the single-chain chimeric polypeptide further comprises a linker sequence between the first target-binding domain and the soluble tissue factor domain.

Embodiment B4. The single-chain chimeric polypeptide of any one of embodiments B1-B3, wherein the soluble tissue factor domain and the second target-binding domain directly abut each other.

Embodiment B5. The single-chain chimeric polypeptide of any one of embodiments B1-B3, wherein the single-chain chimeric polypeptide further comprises a linker sequence between the soluble tissue factor domain and the second target-binding domain.

Embodiment B6. The single-chain chimeric polypeptide of embodiment B1, wherein the first target-binding domain and the second target-binding domain directly abut each other.

Embodiment B7. The single-chain chimeric polypeptide of embodiment BI, wherein the single-chain chimeric polypeptide further comprises a linker sequence between the first target-binding domain and the second target-binding domain.

Embodiment B8. The single-chain chimeric polypeptide of embodiment B6 or B7, wherein the second target-binding domain and the soluble tissue factor domain directly abut each other.

Embodiment B9. The single-chain chimeric polypeptide of embodiment B6 or B7, wherein the single-chain chimeric polypeptide further comprises a linker sequence between the second target-binding domain and the soluble tissue factor domain.

Embodiment B10. The single-chain chimeric polypeptide of any one of embodiments B1-B9, wherein both the first target-binding domain and the second target-binding domain is a soluble interleukin protein.

Embodiment B11. The single-chain chimeric polypeptide of embodiment B10, wherein the first target-binding domain and the second target-binding domain is a soluble IL-2 protein.

Embodiment B12. The single-chain chimeric polypeptide of embodiment B11, wherein the soluble IL-2 protein is a soluble human IL-2 protein.

Embodiment B13. The single-chain chimeric polypeptide of embodiment B12, wherein the soluble human IL-2 protein comprises SEQ ID NO: 78.

Embodiment B14. The single-chain chimeric polypeptide of embodiment B10, wherein the first target-binding domain and the second target-binding domain is a soluble IL-15 protein.

Embodiment B15. The single-chain chimeric polypeptide of embodiment B14, wherein the soluble IL-15 protein is a soluble human IL-15 protein.

Embodiment B16. The single-chain chimeric polypeptide of embodiment B15, wherein the soluble human IL-15 protein comprises SEQ ID NO: 82.

Embodiment B17. The single-chain chimeric polypeptide of any one of embodiments B1-B16, wherein the soluble tissue factor domain is a soluble human tissue factor domain.

Embodiment B18. The single-chain chimeric polypeptide of embodiment B17, wherein the soluble human tissue factor domain comprises a sequence that is at least 80% identical to SEQ ID NO: 93.

Embodiment B19. The single-chain chimeric polypeptide of embodiment B18, wherein the soluble human tissue factor domain comprises a sequence that is at least 90% identical to SEQ ID NO: 93.

Embodiment B20. The single-chain chimeric polypeptide of embodiment B19, wherein the soluble human tissue factor domain comprises a sequence that is at least 95% identical to SEQ ID NO: 93.

Embodiment B21. The single-chain chimeric polypeptide of any one of embodiments B17-B20, wherein the soluble human tissue factor domain does not comprise one or more of:
  a lysine at an amino acid position that corresponds to amino acid position 20 of mature wildtype human tissue factor protein;
  an isoleucine at an amino acid position that corresponds to amino acid position 22 of mature wildtype human tissue factor protein;

a tryptophan at an amino acid position that corresponds to amino acid position 45 of mature wildtype human tissue factor protein;

an aspartic acid at an amino acid position that corresponds to amino acid position 58 of mature wildtype human tissue factor protein;

a tyrosine at an amino acid position that corresponds to amino acid position 94 of mature wildtype human tissue factor protein;

an arginine at an amino acid position that corresponds to amino acid position 135 of mature wildtype human tissue factor protein; and a phenylalanine at an amino acid position that corresponds to amino acid position 140 of mature wildtype human tissue factor protein.

Embodiment B22. The single-chain chimeric polypeptide of embodiment B21, wherein the soluble human tissue factor domain does not comprise any of:

a lysine at an amino acid position that corresponds to amino acid position 20 of mature wildtype human tissue factor protein;

an isoleucine at an amino acid position that corresponds to amino acid position 22 of mature wildtype human tissue factor protein;

a tryptophan at an amino acid position that corresponds to amino acid position 45 of mature wildtype human tissue factor protein;

an aspartic acid at an amino acid position that corresponds to amino acid position 58 of mature wildtype human tissue factor protein;

a tyrosine at an amino acid position that corresponds to amino acid position 94 of mature wildtype human tissue factor protein;

an arginine at an amino acid position that corresponds to amino acid position 135 of mature wildtype human tissue factor protein; and a phenylalanine at an amino acid position that corresponds to amino acid position 140 of mature wildtype human tissue factor protein.

Embodiment B23. The single-chain chimeric polypeptide of any one of embodiments B1-B22, wherein the soluble tissue factor domain is not capable of binding Factor VIIa.

Embodiment B24. The single-chain chimeric polypeptide of any one of embodiments B1-B23, wherein the soluble tissue factor domain does not convert inactive Factor X into Factor Xa.

Embodiment B25. The single-chain chimeric polypeptide of any one of embodiments B1-B24, wherein the single-chain chimeric polypeptide does not stimulate blood coagulation in a mammal.

Embodiment B26. The single-chain chimeric polypeptide of any one of embodiments B1-B25, wherein the single-chain chimeric polypeptide further comprises one or more additional target-binding domains at its N- and/or C-terminus.

Embodiment B27. The single-chain chimeric polypeptide of embodiment B26, wherein the single-chain chimeric polypeptide comprises one or more additional target-binding domains at its N-terminus.

Embodiment B28. The single-chain chimeric polypeptide of embodiment B27, wherein one or more additional target-binding domains directly abuts the first target-binding domain, the second target-binding domain, or the soluble tissue factor domain.

Embodiment B29. The single-chain chimeric polypeptide of embodiment B28, wherein the single-chain chimeric polypeptide further comprises a linker sequence between one of the at least one additional target-binding domains and the first target-binding domain, the second target-binding domain, or the soluble tissue factor domain.

Embodiment B30. The single-chain chimeric polypeptide of embodiment B26, wherein the single-chain chimeric polypeptide comprises one or more additional target-binding domains at its C-terminus.

Embodiment B31. The single-chain chimeric polypeptide of embodiment B30, wherein one of the one or more additional target-binding domains directly abuts the first target-binding domain, the second target-binding domain, or the soluble tissue factor domain.

Embodiment B32. The single-chain chimeric polypeptide of embodiment B30, wherein the single-chain chimeric polypeptide further comprises a linker sequence between one of the at least one additional target-binding domains and the first target-binding domain, the second target-binding domain, or the soluble tissue factor domain.

Embodiment B33. The single-chain chimeric polypeptide of embodiment B26, wherein the single-chain chimeric polypeptide comprises one or more additional target binding domains at its N-terminus and the C-terminus.

Embodiment B34. The single-chain chimeric polypeptide of embodiment B33, wherein one of the one or more additional antigen binding domains at the N-terminus directly abuts the first target-binding domain, the second target-binding domain, or the soluble tissue factor domain.

Embodiment B35. The single-chain chimeric polypeptide of embodiment B33, wherein the single-chain chimeric polypeptide further comprises a linker sequence between one of the one or more additional antigen-binding domains at the N-terminus and the first target-binding domain, the second target-binding domain, or the soluble tissue factor domain.

Embodiment B36. The single-chain chimeric polypeptide of embodiment B33, wherein one of the one or more additional antigen binding domains at the C-terminus directly abuts the first target-binding domain, the second target-binding domain, or the soluble tissue factor domain.

Embodiment B37. The single-chain chimeric polypeptide of embodiment B33, wherein the single-chain chimeric polypeptide further comprises a linker sequence between one of the one or more additional antigen-binding domains at the C-terminus and the first target-binding domain, the second target-binding domain, or the soluble tissue factor domain.

Embodiment B38. The single-chain chimeric polypeptide of any one of embodiments B26-B37, wherein each of the first target-binding domain, the second target-binding domain, and the one or more additional target-binding domains bind specifically to an IL-2 receptor or an IL-15 receptor.

Embodiment B39. The single-chain chimeric polypeptide of embodiment B38, wherein each of the first target-binding domain, the second target-binding domain, and the one or more additional target-binding domains comprise the same amino acid sequence.

Embodiment B40. The single-chain chimeric polypeptide of any one of embodiments B26-B37, wherein the one or more additional target-binding domains is an antigen-binding domain.

Embodiment B41. The single-chain chimeric polypeptide of embodiment B40, wherein the antigen-binding domain comprises a scFv or a single domain antibody.

Embodiment B42. The single-chain chimeric polypeptide of any one of embodiments B26-B37, B40, and B41, wherein the one or more additional target-binding domains bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, a receptor for CD122, and a receptor for CD28.

Embodiment B43. The single-chain chimeric polypeptide of any one of embodiments B6-B37, B40, and B41, wherein the one or more additional target-binding domains is a soluble interleukin or cytokine protein.

Embodiment B44. The single-chain chimeric polypeptide of embodiment B43, wherein the soluble interleukin or cytokine protein is selected from the group consisting of: IL-1, IL-2, IL-3, IL-7, IL-8, IL-10, IL-12, IL-15, IL-17, IL-18, IL-21, PDGF-DD, and SCF.

Embodiment B45. The single-chain chimeric polypeptide of any one of embodiments B6-B37, B40, and B41, wherein the one or more additional target-binding domains is a soluble interleukin or cytokine receptor.

Embodiment B46. The single-chain chimeric polypeptide of embodiment B45, wherein the soluble receptor is a soluble TGF-β receptor II (TGF-βRII) and a soluble TGF-βRIII.

Embodiment B47. The single-chain chimeric polypeptide of any one of embodiments B1-B46, wherein the single-chain chimeric polypeptide further comprises a signal sequence at its N-terminal end.

Embodiment B48. The single-chain chimeric polypeptide of any one of embodiments B1-B47, wherein the single-chain chimeric polypeptide further comprises a peptide tag positioned at the N-terminal end or the C-terminal end of the single-chain chimeric polypeptide.

Embodiment B49. A composition comprising any of the single-chain chimeric polypeptides of embodiments B1-B48.

Embodiment B50. The composition of embodiment B49, wherein the composition is a pharmaceutical composition.

Embodiment B51. A kit comprising at least one dose of the composition of embodiment B49 or B50.

Embodiment B52. A nucleic acid encoding any of the single-chain chimeric polypeptides of any one of embodiments B1-B48.

Embodiment B53. A vector comprising the nucleic acid of embodiment B52.

Embodiment B54. The vector of embodiment B53, wherein the vector is an expression vector.

Embodiment B55. A cell comprising the nucleic acid of embodiment B52 or the vector of embodiment B53 or B54.

Embodiment B56. A method of producing a single-chain chimeric polypeptide, the method comprising:

culturing the cell of embodiment B55 in a culture medium under conditions sufficient to result in the production of the single-chain chimeric polypeptide; and recovering the single-chain chimeric polypeptide from the cell and/or the culture medium.

Embodiment B57. A single-chain chimeric polypeptide produced by the method of embodiment B56.

Embodiment B58. The single-chain chimeric polypeptide of embodiment B21, wherein the soluble human tissue factor domain comprises a sequence that is at least 80% identical to SEQ ID NO: 97.

Embodiment B59. The single-chain chimeric polypeptide of embodiment B58, wherein the soluble human tissue factor domain comprises a sequence that is at least 90% identical to SEQ ID NO: 97.

Embodiment B60. The single-chain chimeric polypeptide of embodiment B59, wherein the soluble human tissue factor domain comprises a sequence that is at least 95% identical to SEQ ID NO: 97.

Embodiment B61. The single-chain chimeric polypeptide of embodiment B60, wherein the soluble human tissue factor domain comprises a sequence that is 100% identical to SEQ ID NO: 97.

Embodiment B62. The single-chain chimeric polypeptide of embodiment B21, wherein the soluble human tissue factor domain comprises a sequence that is at least 80% identical to SEQ ID NO: 98.

Embodiment B63. The single-chain chimeric polypeptide of embodiment B62, wherein the soluble human tissue factor domain comprises a sequence that is at least 90%

Embodiment B64. The single-chain chimeric polypeptide of embodiment B63, wherein the soluble human tissue factor domain comprises a sequence that is at least 95% identical to SEQ ID NO: 98.

Embodiment B65. The single-chain chimeric polypeptide of embodiment B64, wherein the soluble human tissue factor domain comprises a sequence that is 100% identical to SEQ ID NO: 98.

Embodiment C1. A multi-chain chimeric polypeptide comprising:

(a) a first chimeric polypeptide comprising:
(i) a first target-binding domain;
(ii) a soluble tissue factor domain; and
(iii) a first domain of a pair of affinity domains;

(b) a second chimeric polypeptide comprising:
(i) a second domain of a pair of affinity domains; and
(ii) a second target-binding domain, wherein the first chimeric polypeptide and the second chimeric polypeptide associate through the binding of the first domain and the second domain of the pair of affinity domains.

Embodiment C2. The multi-chain chimeric polypeptide of embodiment C1, wherein the first target-binding domain and the soluble tissue factor domain directly abut each other in the first chimeric polypeptide.

Embodiment C3. The multi-chain chimeric polypeptide of embodiment C1, wherein the first chimeric polypeptide further comprises a linker sequence between the first target-binding domain and the soluble tissue factor domain in the first chimeric polypeptide.

Embodiment C4. The multi-chain chimeric polypeptide of any one of embodiments C1-C3, wherein the soluble tissue factor domain and the first domain of the pair of affinity domains directly abut each other in the first chimeric polypeptide.

Embodiment C5. The multi-chain chimeric polypeptide of any one of embodiments C1-C3, wherein the first chimeric polypeptide further comprises a linker sequence between the soluble tissue factor domain and the first domain of the pair of affinity domains in the first chimeric polypeptide.

Embodiment C6. The multi-chain chimeric polypeptide of any one of embodiments C1-C5, wherein the second domain of the pair of affinity domains and the second target-binding domain directly abut each other in the second chimeric polypeptide.

Embodiment C7. The multi-chain chimeric polypeptide of any one of embodiments C1-C5, wherein second chimeric polypeptide further comprises a linker sequence between the second domain of the pair of affinity domains and the second target-binding domain in the second chimeric polypeptide.

Embodiment C8. The multi-chain chimeric polypeptide of any one of embodiments C1-C7, wherein the first target-binding domain and the second target-binding domain bind specifically to the same antigen.

Embodiment C9. The multi-chain chimeric polypeptide of embodiment C8, wherein the first target-binding domain and the second target-binding domain bind specifically to the same epitope.

Embodiment C10. The multi-chain chimeric polypeptide of embodiment C9, wherein the first target-binding domain and the second target-binding domain comprise the same amino acid sequence.

Embodiment C11. The multi-chain chimeric polypeptide of any one of embodiments C1-C7, wherein the first target-binding domain and the second target-binding domain bind specifically to different antigens.

Embodiment C12. The multi-chain chimeric polypeptide of any one of embodiments C1-C11, wherein one or both of the first target-binding domain and the second target-binding domain is an antigen-binding domain.

Embodiment C13. The multi-chain chimeric polypeptide of embodiment C12, wherein the first target-binding domain and the second target-binding domain are each antigen-binding domains.

Embodiment C14. The multi-chain chimeric polypeptide of embodiment C12 or C13, wherein antigen-binding domain comprises a scFv or a single domain antibody.

Embodiment C15. The multi-chain chimeric polypeptide of any one of embodiments C1-C14, wherein one or both of the first target-binding domain and the second target-binding domain bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7113, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, a receptor for CD122, and a receptor for CD28.

Embodiment C16. The multi-chain chimeric polypeptide of any one of embodiments C1-C14, wherein one or both of the first target-binding domain and the second target-binding domain is a soluble interleukin or cytokine protein.

Embodiment C17. The multi-chain chimeric polypeptide of embodiment C16, wherein the soluble interleukin or cytokine protein is selected from the group consisting of: IL-1, IL-2, IL-3, IL-7, IL-8, IL-10, IL-12, IL-15, IL-17, IL-18, IL-21, PDGF-DD, SCF, FLT3L, MICA, MICB, and a ULP16-binding protein.

Embodiment C18. The multi-chain chimeric polypeptide of any one of embodiments C1-C14, wherein one or both of the first target-binding domain and the second target-binding domain is a soluble interleukin or cytokine receptor.

Embodiment C19. The multi-chain chimeric polypeptide of embodiment C18, wherein the soluble receptor is a soluble TGF-β receptor II (TGF-β RII), a soluble TGF-βRIII, a soluble NKG2D, a soluble NKp30, a soluble NKp44, a soluble NKp46, a soluble DNAM1, a scMHCI, a scMHCII, a scTCR, a soluble CD155, or a soluble CD28.

Embodiment C20. The multi-chain chimeric polypeptide of any one of embodiments C1-C19, wherein the first chimeric polypeptide further comprises one or more additional target-binding domain(s), where at least one of the one or more additional antigen-binding domain(s) is positioned between the soluble tissue factor domain and the first domain of the pair of affinity domains.

Embodiment C21. The multi-chain chimeric polypeptide of embodiment C20, wherein the first chimeric polypeptide further comprises a linker sequence between the soluble tissue factor domain and the at least one of the one or more additional antigen-binding domain(s), and/or a linker sequence between the at least one of the one or more additional antigen-binding domain(s) and the first domain of the pair of affinity domains.

Embodiment C22. The multi-chain chimeric polypeptide of any one of embodiments C1-C19, wherein the first chimeric polypeptide further comprises one or more additional target-binding domains at the N-terminal and/or C-terminal end of the first chimeric polypeptide.

Embodiment C23. The multi-chain chimeric polypeptide of embodiment C22, wherein at least one of the one or more additional target-binding domains directly abuts the first domain of the pair of affinity domains in the first chimeric polypeptide.

Embodiment C24. The multi-chain chimeric polypeptide of embodiment C22, wherein the first chimeric polypeptide further comprises a linker sequence between the at least one of the one or more additional target-binding domains and the first domain of the pair of affinity domains.

Embodiment C25. The multi-chain chimeric polypeptide of embodiment C22, wherein the at least one of the one or more additional target-binding domains directly abuts the first target-binding domain in the first chimeric polypeptide.

Embodiment C26. The multi-chain chimeric polypeptide of embodiment C22, wherein the first chimeric polypeptide further comprises a linker sequence between the at least one of the one or more additional target-binding domains and the first target-binding domain.

Embodiment C27. The multi-chain chimeric polypeptide of embodiment C22, wherein at least one of the one or more additional target-binding domains is disposed at the N- and/or C-terminus of the first chimeric polypeptide, and at least one of the one or more additional target-binding domains is positioned between the soluble tissue factor domain and the first domain of the pair of affinity domains in the first chimeric polypeptide.

Embodiment C28. The multi-chain chimeric polypeptide of embodiment C27, wherein the at least one additional target-binding domain of the one or more additional target-binding domains disposed at the N-terminus directly abuts the first target-binding domain or the first domain of the pair of affinity domains in the first chimeric polypeptide.

Embodiment C29. The multi-chain chimeric polypeptide of embodiment C27, wherein the first chimeric polypeptide further comprises a linker sequence disposed between the at least one additional target-binding domain and the first target-binding domain or the first domain of the pair of affinity domains in the first chimeric polypeptide.

Embodiment C30. The multi-chain chimeric polypeptide of embodiment C27, wherein the at least one additional target-binding domain of the one or more additional target-binding domains disposed at the C-terminus directly abuts the first target-binding domain or the first domain of the pair of affinity domains in the first chimeric polypeptide.

Embodiment C31. The multi-chain chimeric polypeptide of embodiment C27, wherein the first chimeric polypeptide further comprises a linker sequence disposed between the at least one additional target-binding domain and the first target-binding domain or the first domain of the pair of affinity domains in the first chimeric polypeptide.

Embodiment C32. The multi-chain chimeric polypeptide of embodiment C27, wherein the at least one of the one or more additional target-binding domains positioned between the soluble tissue factor domain and the first domain of the pair of affinity domains, directly abuts the soluble tissue factor domain and/or the first domain of the pair of affinity domains.

Embodiment C33. The multi-chain chimeric polypeptide of embodiment C27, wherein the first chimeric polypeptide further comprises a linker sequence disposed (i) between the soluble tissue factor domain and the at least one of the one or more additional target-binding domains positioned between the soluble tissue factor domain and the first domain of the pair of affinity domains, and/or (ii) between the first domain of the pair of affinity domains and the at least one of the one or more additional target-binding domains positioned between the soluble tissue factor domain and the first domain of the pair of affinity domains.

Embodiment C34. The multi-chain chimeric polypeptide of any one of embodiments C1-C33, wherein the second chimeric polypeptide further comprises one or more additional target-binding domains at the N-terminal end or the C-terminal end of the second chimeric polypeptide.

Embodiment C35. The multi-chain chimeric polypeptide of embodiment C34, wherein at least one of the one or more additional target-binding domains directly abuts the second domain of the pair of affinity domains in the second chimeric polypeptide.

Embodiment C36. The multi-chain chimeric polypeptide of embodiment C34, wherein the second chimeric polypeptide further comprises a linker sequence between at least one of the one or more additional target-binding domains and the second domain of the pair of affinity domains in the second chimeric polypeptide.

Embodiment C37. The multi-chain chimeric polypeptide of embodiment C34, wherein at least one of the one or more additional target-binding domains directly abuts the second target-binding domain in the second chimeric polypeptide.

Embodiment C38. The multi-chain chimeric polypeptide of embodiment C34, wherein the second chimeric polypeptide further comprises a linker sequence between at least one of the one or more additional target-binding domains and the second target-binding domain in the second chimeric polypeptide.

Embodiment C39. The multi-chain chimeric polypeptide of any one of embodiments C20-C38, wherein two or more of the first target-binding domain, the second target-binding domain, and the one or more additional target-binding domains bind specifically to the same antigen.

Embodiment C40. The multi-chain chimeric polypeptide of embodiment C39, wherein two or more of the first target-binding domain, the second target-binding domain, and the one or more additional target-binding domains bind specifically to the same epitope.

Embodiment C41. The multi-chain chimeric polypeptide of embodiment C40, wherein two or more of the first target-binding domain, the second target-binding domain, and the one or more additional target-binding domains comprise the same amino acid sequence.

Embodiment C42. The multi-chain chimeric polypeptide of embodiment C39, wherein the first target-binding domain, the second target-binding domain, and the one or more additional target-binding domains each bind specifically to the same antigen.

Embodiment C43. The multi-chain chimeric polypeptide of embodiment C42, wherein the first target-binding domain, the second target-binding domain, and the one or more additional target-binding domains each bind specifically to the same epitope.

Embodiment C44. The multi-chain chimeric polypeptide of embodiment C43, wherein the first target-binding domain, the second target-binding domain, and the one or more additional target-binding domains each comprise the same amino acid sequence.

Embodiment C45. The multi-chain chimeric polypeptide of any one of embodiments C20-C38, wherein the first target-binding domain, the second target-binding domain, and the one or more additional target-binding domains bind specifically to different antigens.

Embodiment C46. The multi-chain chimeric polypeptide of any one of embodiments C20-C45, wherein one or more of the first target-binding domain, the second target-binding domain, and the one or more target-binding domains is an antigen-binding domain.

Embodiment C47. The multi-chain chimeric polypeptide of embodiment C46, wherein the first target-binding domain, the second target-binding domain, and the one or more additional target-binding domains are each an antigen-binding domain.

Embodiment C48. The multi-chain chimeric polypeptide of embodiment C47, wherein antigen-binding domain comprises a scFv.

Embodiment C49. The multi-chain chimeric polypeptide of any one of embodiments C20-C48, wherein one or more of the first target-binding domain, the second target-binding domain, and the one or more target-binding domains bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, a receptor for CD122, and a receptor for CD3, and a receptor for CD28.

Embodiment C50. The multi-chain chimeric polypeptide of any one of embodiments C20-C48, wherein one or more of the first target-binding domain, the second target-binding domain, and the one or more additional target-binding domains is a soluble interleukin or cytokine protein.

Embodiment C51. The multi-chain chimeric polypeptide of embodiment C50, wherein the soluble interleukin, cytokine, or ligand protein is selected from the group consisting of: IL-1, IL-2, IL-3, IL-7, IL-8, IL-10, IL-12, IL-15, IL-17, IL-18, IL-21, PDGF-DD, and SCF, FLT3L, MICA, MICB, and a ULP16-binding protein.

Embodiment C52. The multi-chain chimeric polypeptide of any one of embodiments C20-C48, wherein one or more of the first target-binding domain, the second target-binding domain, and the one or more additional target-binding domains is a soluble interleukin or cytokine receptor.

Embodiment C53. The multi-chain chimeric polypeptide of embodiment C52, wherein the soluble receptor is a soluble TGF-β receptor II (TGF-3 RII), a soluble TGF-βRIII, a soluble NKG2D, a soluble NKp30, a soluble NKp44, a soluble NKp46, a soluble DNAM1, a scMHCI, a scMHCII, a scTCR, a soluble CD155, a soluble CD122, a soluble CD3, or a soluble CD28.

Embodiment C54. The multi-chain chimeric polypeptide of any one of embodiments C1-C53, wherein the first chimeric polypeptide further comprises a peptide tag at the N-terminal end or the C-terminal end of the first chimeric polypeptide.

Embodiment C55. The multi-chain chimeric polypeptide of any one of embodiments C1-C53, wherein the second chimeric polypeptide further comprises a peptide tag at the N-terminal end or the C-terminal end of the second chimeric polypeptide.

Embodiment C56. The multi-chain chimeric polypeptide of any one of embodiments C1-C55, wherein the soluble tissue factor domain is a soluble human tissue factor domain.

Embodiment C57. The multi-chain chimeric polypeptide of embodiment C56, wherein the soluble human tissue factor domain comprises a sequence that is at least 80% identical to SEQ ID NO: 93.

Embodiment C58. The multi-chain chimeric polypeptide of embodiment C57, wherein the soluble human tissue factor domain comprises a sequence that is at least 90% identical to SEQ ID NO: 93.

Embodiment C59. The multi-chain chimeric polypeptide of embodiment C58, wherein the soluble human tissue factor domain comprises a sequence that is at least 95% identical to SEQ ID NO: 93.

Embodiment C60. The multi-chain chimeric polypeptide of any one of embodiments C56-C59, wherein the soluble human tissue factor domain does not comprise one or more of:
  a lysine at an amino acid position that corresponds to amino acid position 20 of mature wildtype human tissue factor protein;
  an isoleucine at an amino acid position that corresponds to amino acid position 22 of mature wildtype human tissue factor protein;
  a tryptophan at an amino acid position that corresponds to amino acid position 45 of mature wildtype human tissue factor protein;
  an aspartic acid at an amino acid position that corresponds to amino acid position 58 of mature wildtype human tissue factor protein;
  a tyrosine at an amino acid position that corresponds to amino acid position 94 of mature wildtype human tissue factor protein;
  an arginine at an amino acid position that corresponds to amino acid position 135 of mature wildtype human tissue factor protein; and
  a phenylalanine at an amino acid position that corresponds to amino acid position 140 of mature wildtype human tissue factor protein.

Embodiment C61. The multi-chain chimeric polypeptide of embodiment C60, wherein the soluble human tissue factor domain does not comprise any of:
  a lysine at an amino acid position that corresponds to amino acid position 20 of mature wildtype human tissue factor protein;
  an isoleucine at an amino acid position that corresponds to amino acid position 22 of mature wildtype human tissue factor protein;
  a tryptophan at an amino acid position that corresponds to amino acid position 45 of mature wildtype human tissue factor protein;
  an aspartic acid at an amino acid position that corresponds to amino acid position 58 of mature wildtype human tissue factor protein;
  a tyrosine at an amino acid position that corresponds to amino acid position 94 of mature wildtype human tissue factor protein;
  an arginine at an amino acid position that corresponds to amino acid position 135 of mature wildtype human tissue factor protein; and
  a phenylalanine at an amino acid position that corresponds to amino acid position 140 of mature wildtype human tissue factor protein.

Embodiment C62. The multi-chain chimeric polypeptide of any one of embodiments C1-C61, wherein the soluble tissue factor domain is not capable of binding to Factor VIIa.

Embodiment C63. The multi-chain chimeric polypeptide of any one of embodiments C1-C62, wherein the soluble tissue factor domain does not convert inactive Factor X into Factor Xa.

Embodiment C64. The multi-chain chimeric polypeptide of any one of embodiments C1-C63, wherein the multi-chain chimeric polypeptide does not stimulate blood coagulation in a mammal.

Embodiment C65. The multi-chain chimeric polypeptide of any one of embodiments C1-C64, wherein the pair of affinity domains is a sushi domain from an alpha chain of human IL-15 receptor (IL-15Rα) and a soluble IL-15.

Embodiment C66. The multi-chain chimeric polypeptide of embodiment C65, wherein the soluble IL-15 has a D8N or D8A amino acid substitution.

Embodiment C67. The multi-chain chimeric polypeptide of embodiment C65 or C66, wherein the human IL-15Rα is a mature full-length IL-15Rα.

Embodiment C68. The multi-chain chimeric polypeptide of any one of embodiments C1-C64, wherein the pair of affinity domains is selected from the group consisting of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25.

Embodiment C69. The multi-chain chimeric polypeptide of any one of embodiments C1-C68, wherein the first chimeric polypeptide and/or the second chimeric polypeptide further comprises a signal sequence at its N-terminal end.

Embodiment C70. A composition comprising any of the multi-chain chimeric polypeptides of embodiments C1-C69.

Embodiment C71. The composition of embodiment C70, wherein the composition is a pharmaceutical composition.

Embodiment C72. A kit comprising at least one dose of the composition of embodiment C70 or C71.

Embodiment C73. Nucleic acid encoding any of the multi-chain chimeric polypeptides of any one of embodiments C1-C69.

Embodiment C74. A vector comprising the nucleic acid of embodiment C73.

Embodiment C75. The vector of embodiment C74, wherein the vector is an expression vector.

Embodiment C76. A cell comprising the nucleic acid of embodiment C73 or the vector of embodiment C74 or C75.

Embodiment C77. A method of producing a multi-chain chimeric polypeptide, the method comprising:
culturing the cell of embodiment C76 in a culture medium under conditions sufficient to result in the production of the multi-chain chimeric polypeptide; and
recovering the multi-chain chimeric polypeptide from the cell and/or the culture medium.

Embodiment C78. A multi-chain chimeric polypeptide produced by the method of embodiment C77.

Embodiment C79. The multi-chain chimeric polypeptide of embodiment A56, wherein the soluble human tissue factor domain comprises a sequence that is at least 80% identical to SEQ ID NO: 97.

Embodiment C80. The multi-chain chimeric polypeptide of embodiment C79, wherein the soluble human tissue factor domain comprises a sequence that is at least 90% identical to SEQ ID NO: 97.

Embodiment C81. The multi-chain chimeric polypeptide of embodiment C80, wherein the soluble human tissue factor domain comprises a sequence that is at least 95% identical to SEQ ID NO: 97.

Embodiment C82. The multi-chain chimeric polypeptide of embodiment C81, wherein the soluble human tissue factor domain comprises a sequence that is 100% identical to SEQ ID NO: 97.

Embodiment C83. The multi-chain chimeric polypeptide of embodiment C56, wherein the soluble human tissue factor domain comprises a sequence that is at least 80% identical to SEQ ID NO: 98.

Embodiment C84. The multi-chain chimeric polypeptide of embodiment C83, wherein the soluble human tissue factor domain comprises a sequence that is at least 90% identical to SEQ ID NO: 98.

Embodiment C85. The multi-chain chimeric polypeptide of embodiment C84, wherein the soluble human tissue factor domain comprises a sequence that is at least 95% identical to SEQ ID NO: 98.

Embodiment C86. The multi-chain chimeric polypeptide of embodiment C85, wherein the soluble human tissue factor domain comprises a sequence that is 100% identical to SEQ ID NO: 98.

Embodiment DI. A multi-chain chimeric polypeptide comprising:
(a) a first chimeric polypeptide comprising:
(i) a first target-binding domain;
(ii) a soluble tissue factor domain; and
(iii) a first domain of a pair of affinity domains;
(b) a second chimeric polypeptide comprising:
(i) a second domain of a pair of affinity domains; and
(ii) a second target-binding domain,
wherein:
the first chimeric polypeptide and the second chimeric polypeptide associate through the binding of the first domain and the second domain of the pair of affinity domains;
the first target-binding domain and the second targeting-binding domain each independently bind specifically to a receptor of IL-18 or a receptor of IL-12.

Embodiment D2. The multi-chain chimeric polypeptide of embodiment D1, wherein the first target-binding domain and the soluble tissue factor domain directly abut each other in the first chimeric polypeptide.

Embodiment D3. The multi-chain chimeric polypeptide of embodiment D1, wherein the first chimeric polypeptide further comprises a linker sequence between the first target-binding domain and the soluble tissue factor domain in the first chimeric polypeptide.

Embodiment D4. The multi-chain chimeric polypeptide of any one of embodiments D1-D3, wherein the soluble tissue factor domain and the first domain of the pair of affinity domains directly abut each other in the first chimeric polypeptide.

Embodiment D5. The multi-chain chimeric polypeptide of any one of embodiments D1-D3, wherein the first chimeric polypeptide further comprises a linker sequence between the soluble tissue factor domain and the first domain of the pair of affinity domains in the first chimeric polypeptide.

Embodiment D6. The multi-chain chimeric polypeptide of any one of embodiments D1-D5, wherein the second domain of the pair of affinity domains and the second target-binding domain directly abut each other in the second chimeric polypeptide.

Embodiment D7. The multi-chain chimeric polypeptide of any one of embodiments D1-D5, wherein second chimeric polypeptide further comprises a linker sequence between the second domain of the pair of affinity domains and the second target-binding domain in the second chimeric polypeptide.

Embodiment D8. The multi-chain chimeric polypeptide of any one of embodiments D1-D7, wherein the soluble tissue factor domain is a soluble human tissue factor domain.

Embodiment D9. The multi-chain chimeric polypeptide of embodiment D8, wherein the soluble human tissue factor domain comprises a sequence that is at least 80% identical to SEQ ID NO: 93.

Embodiment D10. The multi-chain chimeric polypeptide of embodiment D9, wherein the soluble human tissue factor domain comprises a sequence that is at least 90% identical to SEQ ID NO: 93.

Embodiment D11. The multi-chain chimeric polypeptide of embodiment D10, wherein the soluble human tissue factor domain comprises a sequence that is at least 95% identical to SEQ ID NO: 93.

Embodiment D12. The multi-chain chimeric polypeptide of any one of embodiments D8-D11, wherein the soluble human tissue factor domain does not comprise one or more of:
a lysine at an amino acid position that corresponds to amino acid position 20 of mature wildtype human tissue factor protein;
an isoleucine at an amino acid position that corresponds to amino acid position 22 of mature wildtype human tissue factor protein;

a tryptophan at an amino acid position that corresponds to amino acid position 45 of mature wildtype human tissue factor protein;

an aspartic acid at an amino acid position that corresponds to amino acid position 58 of mature wildtype human tissue factor protein;

a tyrosine at an amino acid position that corresponds to amino acid position 94 of mature wildtype human tissue factor protein;

an arginine at an amino acid position that corresponds to amino acid position 135 of mature wildtype human tissue factor protein; and a phenylalanine at an amino acid position that corresponds to amino acid position 140 of mature wildtype human tissue factor protein.

Embodiment D13. The multi-chain chimeric polypeptide of embodiment D12, wherein the soluble human tissue factor domain does not comprise any of:

a lysine at an amino acid position that corresponds to amino acid position 20 of mature wildtype human tissue factor protein;

an isoleucine at an amino acid position that corresponds to amino acid position 22 of mature wildtype human tissue factor protein;

a tryptophan at an amino acid position that corresponds to amino acid position 45 of mature wildtype human tissue factor protein;

an aspartic acid at an amino acid position that corresponds to amino acid position 58 of mature wildtype human tissue factor protein;

a tyrosine at an amino acid position that corresponds to amino acid position 94 of mature wildtype human tissue factor protein;

an arginine at an amino acid position that corresponds to amino acid position 135 of mature wildtype human tissue factor protein; and a phenylalanine at an amino acid position that corresponds to amino acid position 140 of mature wildtype human tissue factor protein.

Embodiment D14. The multi-chain chimeric polypeptide of any one of embodiments D1-D13, wherein the soluble tissue factor domain is not capable of binding to Factor VIIa.

Embodiment D15. The multi-chain chimeric polypeptide of any one of embodiments D1-D14, wherein the soluble tissue factor domain does not convert inactive Factor X into Factor Xa.

Embodiment D16. The multi-chain chimeric polypeptide of any one of embodiments D1-D15, wherein the multi-chain chimeric polypeptide does not stimulate blood coagulation in a mammal.

Embodiment D17. The multi-chain chimeric polypeptide of any one of embodiments D1-D16, wherein the first chimeric polypeptide further comprises a peptide tag at the N-terminal end or the C-terminal end of the first chimeric polypeptide.

Embodiment D18. The multi-chain chimeric polypeptide of any one of embodiments D1-D17, wherein the second chimeric polypeptide further comprises a peptide tag at the N-terminal end or the C-terminal end of the second chimeric polypeptide.

Embodiment D19. The multi-chain chimeric polypeptide of any one of embodiments D1-D18, wherein the first chimeric polypeptide and/or the second chimeric polypeptide further comprises a signal sequence at its N-terminal end.

Embodiment D20. The multi-chain chimeric polypeptide of embodiment D19, wherein the signal sequence comprises SEQ ID NO: 117.

Embodiment D21. The multi-chain chimeric polypeptide of embodiment D20, wherein the signal sequence is SEQ ID NO: 117.

Embodiment D22. The multi-chain chimeric polypeptide of any one of embodiments D1-D21, wherein the pair of affinity domains is a sushi domain from an alpha chain of human IL-15 receptor (IL-15Rα) and a soluble IL-15.

Embodiment D23. The multi-chain chimeric polypeptide of embodiment D22, wherein the soluble IL-15 has a D8N or D8A amino acid substitution.

Embodiment D24. The multi-chain chimeric polypeptide of embodiment D22, wherein the soluble IL-15 comprises a sequence that is 80% identical to SEQ ID NO: 82.

Embodiment D25. The multi-chain chimeric polypeptide of embodiment D24, wherein the soluble IL-15 comprises a sequence that is 90% identical to SEQ ID NO: 82.

Embodiment D26. The multi-chain chimeric polypeptide of embodiment D25, wherein the soluble IL-15 comprises a sequence that is 95% identical to SEQ ID NO: 82.

Embodiment D27. The multi-chain chimeric polypeptide of embodiment D26, wherein the soluble IL-15 comprises SEQ ID NO: 82.

Embodiment D28. The multi-chain chimeric polypeptide of any one of embodiments D22-D27, wherein the sushi domain of IL-15Rα comprises a sushi domain from human IL-15Rα.

Embodiment D29. The multi-chain chimeric polypeptide of embodiment D28, wherein the sushi domain from human IL-15Rα comprises a sequence that is 80% identical to SEQ ID NO: 113.

Embodiment D30. The multi-chain chimeric polypeptide of embodiment D29, wherein the sushi domain from human IL-15Rα comprises a sequence that is 90% identical to SEQ ID NO: 113.

Embodiment D31. The multi-chain chimeric polypeptide of embodiment D30, wherein the sushi domain from human IL-15Rα comprises a sequence that is 95% identical to SEQ ID NO: 113.

Embodiment D32. The multi-chain chimeric polypeptide of embodiment D31, wherein the sushi domain from human IL-15Rα comprises SEQ ID NO: 113.

Embodiment D33. The multi-chain chimeric polypeptide of embodiment D28, wherein the sushi domain from human IL-15Rα is a mature full-length IL-15Rα.

Embodiment D34. The multi-chain chimeric polypeptide of any one of embodiments D1-D21, wherein the pair of affinity domains is selected from the group consisting of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25.

Embodiment D35. The multi-chain chimeric polypeptide of any one of embodiments D1-D34, wherein one or both of the first target-binding domain and the second target-binding domain is an agonistic antigen-binding domain.

Embodiment D36. The multi-chain chimeric polypeptide of embodiment D35, wherein the first target-binding domain and the second target-binding domain are each agonistic antigen-binding domains.

Embodiment D37. The multi-chain chimeric polypeptide of embodiment D35 or D36, wherein antigen-binding domain comprises a scFv or single-domain antibody.

Embodiment D38. The multi-chain chimeric polypeptide of any one of embodiments D1-D34, wherein one or both of the first target-binding domain and the second target-binding domain is a soluble IL-15 or a soluble IL-18.

Embodiment D39. The multi-chain chimeric polypeptide of embodiment D38, wherein the first target-binding domain and the second target-binding domain are each independently a soluble IL-15 or a soluble IL-18.

Embodiment D40. The multi-chain chimeric polypeptide of any one of embodiments D1-D39, wherein the first target-binding domain and the second target-binding domain both bind specifically to a receptor of IL-18 or a receptor of IL-12.

Embodiment D41. The multi-chain chimeric polypeptide of embodiment B40, wherein the first target-binding domain and the second target-binding domain bind specifically to the same epitope.

Embodiment D42. The multi-chain chimeric polypeptide of embodiment D41, wherein the first target-binding domain and the second target-binding domain comprise the same amino acid sequence.

Embodiment D43. The multi-chain chimeric polypeptide of any one of embodiments D1-D39, wherein the first target-binding domain binds specifically to a receptor for IL-12, and the second target-binding domain binds specifically to a receptor for IL-18.

Embodiment D44. The multi-chain chimeric polypeptide of any one of embodiments D1-D39, wherein the first target-binding domain binds specifically to a receptor for IL-18, and the second target-binding domain bind specifically to a receptor for IL-12.

Embodiment D45. The multi-chain chimeric polypeptide of embodiment D44, wherein the first target-binding domain comprises a soluble IL-18.

Embodiment D46. The multi-chain chimeric polypeptide of embodiment D45, wherein the soluble IL-18 is a soluble human IL-18.

Embodiment D47. The multi-chain chimeric polypeptide of embodiment D46, wherein the soluble human IL-18 comprises a sequence at least 80% identical to SEQ ID NO: 109.

Embodiment D48. The multi-chain chimeric polypeptide of embodiment D47, wherein the soluble human IL-18 comprises a sequence at least 90% identical to SEQ ID NO: 109.

Embodiment D49. The multi-chain chimeric polypeptide of embodiment D48, wherein the soluble human IL-18 comprises a sequence at least 95% identical to SEQ ID NO: 109.

Embodiment D50. The multi-chain chimeric polypeptide of embodiment D49, wherein the soluble human IL-18 comprises a sequence of SEQ ID NO: 109.

Embodiment D51. The multi-chain chimeric polypeptide of any one of embodiments D44-D50, wherein the second target-binding domain comprises a soluble IL-12.

Embodiment D52. The multi-chain chimeric polypeptide of embodiment D51, wherein the soluble IL-18 is a soluble human IL-12.

Embodiment D53. The multi-chain chimeric polypeptide of embodiment D52, wherein the soluble human IL-15 comprises a sequence of soluble human IL-12β (p40) and a sequence of soluble human IL-12α (p35).

Embodiment D54. The multi-chain chimeric polypeptide of embodiment D53, wherein the soluble human IL-15 further comprises a linker sequence between the sequence of soluble IL-12β (p40) and the sequence of soluble human IL-12a (p35).

Embodiment D55. The multi-chain chimeric polypeptide of embodiment D54, wherein the linker sequence comprises SEQ ID NO: 102.

Embodiment D56. The multi-chain chimeric polypeptide of any one of embodiments D53-D55, wherein the sequence of soluble human IL-12β (p40) comprises a sequence that is at least 80% identical to SEQ ID NO: 81.

Embodiment D57. The multi-chain chimeric polypeptide of embodiment D56, wherein the sequence of soluble human IL-12β (p40) comprises a sequence that is at least 90% identical to SEQ ID NO: 81.

Embodiment D58. The multi-chain chimeric polypeptide of embodiment D57, wherein the sequence of soluble human IL-12β (p40) comprises a sequence that is at least 95% identical to SEQ ID NO: 81.

Embodiment D59. The multi-chain chimeric polypeptide of embodiment D58, wherein the sequence of soluble human IL-12β (p40) comprises SEQ ID NO: 81.

Embodiment D60. The multi-chain chimeric polypeptide of any one of embodiments D53-D59, wherein the sequence of soluble human IL-12α (p35) comprises a sequence that is at least 80% identical to SEQ ID NO: 80.

Embodiment D61. The multi-chain chimeric polypeptide of embodiment D60, wherein the sequence of soluble human IL-12α (p35) comprises a sequence that is at least 90% identical to SEQ ID NO: 80.

Embodiment D62. The mule-chain chimeric polypeptide of embodiment D61, wherein the sequence of soluble human IL-12α (p35) comprises a sequence that is at least 95% identical to SEQ ID NO: 80.

Embodiment D63. The multi-chain chimeric polypeptide of embodiment D62, wherein the sequence of soluble human IL-12α (p35) comprises SEQ ID NO: 80.

Embodiment D64. The multi-chain chimeric polypeptide of embodiment D1, wherein the first chimeric polypeptide comprises a sequence that is at least 80% identical to SEQ ID NO: 174.

Embodiment D65. The multi-chain chimeric polypeptide of embodiment D64, wherein the first chimeric polypeptide comprises a sequence that is at least 90% identical to SEQ ID NO: 174.

Embodiment D66. The multi-chain chimeric polypeptide of embodiment D65, wherein the first chimeric polypeptide comprises a sequence that is at least 95% identical to SEQ ID NO: 174.

Embodiment D67. The multi-chain chimeric polypeptide of embodiment D66, wherein the first chimeric polypeptide comprises SEQ ID NO: 174.

Embodiment D68. The multi-chain chimeric polypeptide of embodiment D67, wherein the first chimeric polypeptide comprises SEQ ID NO: 176.

Embodiment D69. The multi-chain chimeric polypeptide of any one of embodiments D1 and D64-D68, wherein the second chimeric polypeptide comprises a sequence that is at least 80% identical to SEQ ID NO: 178.

Embodiment D70. The multi-chain chimeric polypeptide of embodiment D69, wherein the second chimeric polypeptide comprises a sequence that is at least 90% identical to SEQ ID NO: 178.

Embodiment D71. The multi-chain chimeric polypeptide of embodiment D70, wherein the second chimeric polypeptide comprises a sequence that is at least 95% identical to SEQ ID NO: 178.

Embodiment D72. The multi-chain chimeric polypeptide of embodiment D71, wherein the second chimeric polypeptide comprises SEQ ID NO: 178.

Embodiment D73. The multi-chain chimeric polypeptide of embodiment D72, wherein the second chimeric polypeptide comprises SEQ ID NO: 180.

Embodiment D74. The multi-chain chimeric polypeptide of any one of embodiments D1-D63, wherein the first chimeric polypeptide further comprises one or more additional target-binding domain(s), where at least one of the one or more additional antigen-binding domain(s) is positioned between the soluble tissue factor domain and the first domain of the pair of affinity domains.

Embodiment D75. The multi-chain chimeric polypeptide of embodiment D74, wherein the first chimeric polypeptide further comprises a linker sequence between the soluble tissue factor domain and the at least one of the one or more additional antigen-binding domain(s), and/or a linker sequence between the at least one of the one or more additional antigen-binding domain(s) and the first domain of the pair of affinity domains.

Embodiment D76. The multi-chain chimeric polypeptide of any one of embodiments D1-D63, wherein the first chimeric polypeptide further comprises one or more additional target-binding domains at the N-terminal and/or C-terminal end of the first chimeric polypeptide.

Embodiment D77. The multi-chain chimeric polypeptide of embodiment D76, wherein at least one of the one or more additional target-binding domains directly abuts the first domain of the pair of affinity domains in the first chimeric polypeptide.

Embodiment D78. The multi-chain chimeric polypeptide of embodiment D76, wherein the first chimeric polypeptide further comprises a linker sequence between the at least one of the one or more additional target-binding domains and the first domain of the pair of affinity domains.

Embodiment D79. The multi-chain chimeric polypeptide of embodiment D76, wherein the at least one of the one or more additional target-binding domains directly abuts the first target-binding domain in the first chimeric polypeptide.

Embodiment D80. The multi-chain chimeric polypeptide of embodiment D76, wherein the first chimeric polypeptide further comprises a linker sequence between the at least one of the one or more additional target-binding domains and the first target-binding domain.

Embodiment D81. The multi-chain chimeric polypeptide of embodiment D76, wherein at least one of the one or more additional target-binding domains is disposed at the N- and/or C-terminus of the first chimeric polypeptide, and at least one of the one or more additional target-binding domains is positioned between the soluble tissue factor domain and the first domain of the pair of affinity domains in the first chimeric polypeptide.

Embodiment D82. The multi-chain chimeric polypeptide of embodiment D81, wherein the at least one additional target-binding domain of the one or more additional target-binding domains disposed at the N-terminus directly abuts the first target-binding domain or the first domain of the pair of affinity domains in the first chimeric polypeptide.

Embodiment D83. The multi-chain chimeric polypeptide of embodiment D81, wherein the first chimeric polypeptide further comprises a linker sequence disposed between the at least one additional target-binding domain and the first target-binding domain or the first domain of the pair of affinity domains in the first chimeric polypeptide.

Embodiment D84. The multi-chain chimeric polypeptide of embodiment D81, wherein the at least one additional target-binding domain of the one or more additional target-binding domains disposed at the C-terminus directly abuts the first target-binding domain or the first domain of the pair of affinity domains in the first chimeric polypeptide.

Embodiment D85. The multi-chain chimeric polypeptide of embodiment D81, wherein the first chimeric polypeptide further comprises a linker sequence disposed between the at least one additional target-binding domain and the first target-binding domain or the first domain of the pair of affinity domains in the first chimeric polypeptide.

Embodiment D86. The multi-chain chimeric polypeptide of embodiment D81, wherein the at least one of the one or more additional target-binding domains positioned between the soluble tissue factor domain and the first domain of the pair of affinity domains, directly abuts the soluble tissue factor domain and/or the first domain of the pair of affinity domains.

Embodiment D87. The multi-chain chimeric polypeptide of embodiment D81, wherein the first chimeric polypeptide further comprises a linker sequence disposed (i) between the soluble tissue factor domain and the at least one of the one or more additional target-binding domains positioned between the soluble tissue factor domain and the first domain of the pair of affinity domains, and/or (ii) between the first domain of the pair of affinity domains and the at least one of the one or more additional target-binding domains positioned between the soluble tissue factor domain and the first domain of the pair of affinity domains.

Embodiment D88. The multi-chain chimeric polypeptide of any one of embodiments D1-D63 and D74-D87, wherein the second chimeric polypeptide further comprises one or more additional target-binding domains at the N-terminal end or the C-terminal end of the second chimeric polypeptide.

Embodiment D89. The multi-chain chimeric polypeptide of embodiment D88, wherein at least one of the one or more additional target-binding domains directly abuts the second domain of the pair of affinity domains in the second chimeric polypeptide.

Embodiment D90. The multi-chain chimeric polypeptide of embodiment D88, wherein the second chimeric polypeptide further comprises a linker sequence between at least one of the one or more additional target-binding domains and the second domain of the pair of affinity domains in the second chimeric polypeptide.

Embodiment D91. The multi-chain chimeric polypeptide of embodiment D88, wherein at least one of the one or more additional target-binding domains directly abuts the second target-binding domain in the second chimeric polypeptide.

Embodiment D92. The multi-chain chimeric polypeptide of embodiment B88, wherein the second chimeric polypeptide further comprises a linker sequence between at least one of the one or more additional target-binding domains and the second target-binding domain in the second chimeric polypeptide.

Embodiment D93. The multi-chain chimeric polypeptide of any one of embodiments D74-D92, wherein two or more of the first target-binding domain, the second target-binding domain, and the one or more additional target-binding domains bind specifically to the same antigen.

Embodiment D94. The multi-chain chimeric polypeptide of embodiment B93, wherein two or more of the first target-binding domain, the second target-binding domain, and the one or more additional target-binding domains bind specifically to the same epitope.

Embodiment D95. The multi-chain chimeric polypeptide of embodiment B94, wherein two or more of the first target-binding domain, the second target-binding domain, and the one or more additional target-binding domains comprise the same amino acid sequence.

Embodiment D96. The multi-chain chimeric polypeptide of any one of embodiments D74-D92, wherein the first target-binding domain, the second target-binding domain, and the one or more additional target-binding domains bind specifically to different antigens.

Embodiment D97. The multi-chain chimeric polypeptide of any one of embodiments D74-D96, wherein the one or more additional antigen-binding domains bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD28.

Embodiment D98. The multi-chain chimeric polypeptide of any one of embodiments D74-D96, wherein the one or more additional target-binding domains is a soluble interleukin or cytokine protein.

Embodiment D99. The multi-chain chimeric polypeptide of embodiment B98, wherein the soluble interleukin, cytokine, or ligand protein is selected from the group consisting of: IL-1, IL-2, IL-3, IL-7, IL-8, IL-10, IL-12, IL-15, IL-17, IL-18, IL-21, PDGF-DD, SCF, FLT3L, MICA, MICB, and a ULP16-binding protein.

Embodiment D100. The multi-chain chimeric polypeptide of any one of embodiments D74-D96, wherein the one or more additional target-binding domains is a soluble interleukin or cytokine receptor.

Embodiment D101. The multi-chain chimeric polypeptide of embodiment B100, wherein the soluble receptor is a soluble TGF-β receptor II (TGF-β RII), a soluble TGF-βRIII, a soluble NKG2D, a soluble NKp30, a soluble NKp44, a soluble NKp46, a soluble DNAM1, a scMHCI, a scMHCII, a scTCR, a soluble CD155, a soluble CD122, or a soluble CD28.

Embodiment D102. A composition comprising any of the multi-chain chimeric polypeptides of embodiments D1-D101.

Embodiment D103. The composition of embodiment D102, wherein the composition is a pharmaceutical composition.

Embodiment D104. A kit comprising at least one dose of the composition of embodiment D102 or D103.

Embodiment D105. Nucleic acid encoding any of the multi-chain chimeric polypeptides of any one of embodiments D1-D101.

Embodiment D106. A vector comprising the nucleic acid of embodiment D105.

Embodiment D107. The vector of embodiment D106, wherein the vector is an expression vector.

Embodiment D108. A cell comprising the nucleic acid of embodiment D105 or the vector of embodiment D106 or D107.

Embodiment D109. A method of producing a multi-chain chimeric polypeptide, the method comprising:
  culturing the cell of embodiment D108 in a culture medium under conditions sufficient to result in the production of the multi-chain chimeric polypeptide; and
  recovering the multi-chain chimeric polypeptide from the cell and/or the culture medium.

Embodiment D110. A multi-chain chimeric polypeptide produced by the method of embodiment D109.

Embodiment D111. The multi-chain chimeric polypeptide of embodiment D8, wherein the soluble human tissue factor domain comprises a sequence that is at least 80% identical to SEQ ID NO: 97.

Embodiment D112. The multi-chain chimeric polypeptide of embodiment D111, wherein the soluble human tissue factor domain comprises a sequence that is at least 90% identical to SEQ ID NO: 97.

Embodiment D113. The multi-chain chimeric polypeptide of embodiment D112, wherein the soluble human tissue factor domain comprises a sequence that is at least 95% identical to SEQ ID NO: 97.

Embodiment D114. The multi-chain chimeric polypeptide of embodiment D113, wherein the soluble human tissue factor domain comprises a sequence that is 100% identical to SEQ ID NO: 97.

Embodiment D115. The multi-chain chimeric polypeptide of embodiment D8, wherein the soluble human tissue factor domain comprises a sequence that is at least 80%

Embodiment D116. The multi-chain chimeric polypeptide of embodiment D115, wherein the soluble human tissue factor domain comprises a sequence that is at least 90% identical to SEQ ID NO: 98.

Embodiment D117. The multi-chain chimeric polypeptide of embodiment D116, wherein the soluble human tissue factor domain comprises a sequence that is at least 95% identical to SEQ ID NO: 98.

Embodiment D118. The multi-chain chimeric polypeptide of embodiment D117, wherein the soluble human tissue factor domain comprises a sequence that is 100% identical to SEQ ID NO: 98.

Embodiment E1. A multi-chain chimeric polypeptide comprising:
  (a) a first chimeric polypeptide comprising:
    (i) a first target-binding domain;
    (ii) a soluble tissue factor domain; and
    (iii) a first domain of a pair of affinity domains;
  (b) a second chimeric polypeptide comprising:
    (i) a second domain of a pair of affinity domains; and
    (ii) a second target-binding domain,
  wherein:
    the first chimeric polypeptide and the second chimeric polypeptide associate through the binding of the first domain and the second domain of the pair of affinity domains; and the first target-binding domain and the second targeting-binding domain each independently bind specifically to a receptor of IL-21 or a ligand of tumor growth factor receptor β II (TGFβRII).

Embodiment E2. The multi-chain chimeric polypeptide of embodiment E1, wherein the first target-binding domain and the soluble tissue factor domain directly abut each other in the first chimeric polypeptide.

Embodiment E3. The multi-chain chimeric polypeptide of embodiments E1, wherein the first chimeric polypeptide further comprises a linker sequence between the first target-binding domain and the soluble tissue factor domain in the first chimeric polypeptide.

Embodiment E4. The multi-chain chimeric polypeptide of any one of embodiments E1-E3, wherein the soluble tissue factor domain and the first domain of the pair of affinity domains directly abut each other in the first chimeric polypeptide.

Embodiment E5. The multi-chain chimeric polypeptide of any one of embodiments E1-E3, wherein the first chimeric polypeptide further comprises a linker sequence between the soluble tissue factor domain and the first domain of the pair of affinity domains in the first chimeric polypeptide.

Embodiment E6. The multi-chain chimeric polypeptide of any one of embodiments E1-E5, wherein the second domain of the pair of affinity domains and the second target-binding domain directly abut each other in the second chimeric polypeptide.

Embodiment E7. The multi-chain chimeric polypeptide of any one of embodiments E1-E5, wherein second chimeric polypeptide further comprises a linker sequence between the second domain of the pair of affinity domains and the second target-binding domain in the second chimeric polypeptide.

Embodiment E8. The multi-chain chimeric polypeptide of any one of embodiments E1-E7, wherein the soluble tissue factor domain is a soluble human tissue factor domain.

Embodiment E9. The multi-chain chimeric polypeptide of embodiment E8, wherein the soluble human tissue factor domain comprises a sequence that is at least 80% identical to SEQ ID NO: 93.

Embodiment E10. The multi-chain chimeric polypeptide of embodiment E9, wherein the soluble human tissue factor domain comprises a sequence that is at least 90% identical to SEQ ID NO: 93.

Embodiment E11. The multi-chain chimeric polypeptide of embodiment E10, wherein the soluble human tissue factor domain comprises a sequence that is at least 95% identical to SEQ ID NO: 93.

Embodiment E12. The multi-chain chimeric polypeptide of any one of embodiments E8-E11, wherein the soluble human tissue factor domain does not comprise one or more of:
  a lysine at an amino acid position that corresponds to amino acid position 20 of mature wildtype human tissue factor protein;
  an isoleucine at an amino acid position that corresponds to amino acid position 22 of mature wildtype human tissue factor protein;
  a tryptophan at an amino acid position that corresponds to amino acid position 45 of mature wildtype human tissue factor protein;
  an aspartic acid at an amino acid position that corresponds to amino acid position 58 of mature wildtype human tissue factor protein;
  a tyrosine at an amino acid position that corresponds to amino acid position 94 of mature wildtype human tissue factor protein;
  an arginine at an amino acid position that corresponds to amino acid position 135 of mature wildtype human tissue factor protein; and
  a phenylalanine at an amino acid position that corresponds to amino acid position 140 of mature wildtype human tissue factor protein.

Embodiment E13. The multi-chain chimeric polypeptide of embodiment E12, wherein the soluble human tissue factor domain does not comprise any of:
  a lysine at an amino acid position that corresponds to amino acid position 20 of mature wildtype human tissue factor protein;
  an isoleucine at an amino acid position that corresponds to amino acid position 22 of mature wildtype human tissue factor protein;
  a tryptophan at an amino acid position that corresponds to amino acid position 45 of mature wildtype human tissue factor protein;
  an aspartic acid at an amino acid position that corresponds to amino acid position 58 of mature wildtype human tissue factor protein;
  a tyrosine at an amino acid position that corresponds to amino acid position 94 of mature wildtype human tissue factor protein;
  an arginine at an amino acid position that corresponds to amino acid position 135 of mature wildtype human tissue factor protein; and
  a phenylalanine at an amino acid position that corresponds to amino acid position 140 of mature wildtype human tissue factor protein.

Embodiment E14. The multi-chain chimeric polypeptide of any one of embodiments E1-E13, wherein the soluble tissue factor domain is not capable of binding to Factor VIIa.

Embodiment E15. The multi-chain chimeric polypeptide of any one of embodiments E1-E14, wherein the soluble tissue factor domain does not convert inactive Factor X into Factor Xa.

Embodiment E16. The multi-chain chimeric polypeptide of any one of embodiments E1-E15, wherein the multi-chain chimeric polypeptide does not stimulate blood coagulation in a mammal.

Embodiment E17. The multi-chain chimeric polypeptide of any one of embodiments E1-E16, wherein the first chimeric polypeptide further comprises a peptide tag at the N-terminal end or the C-terminal end of the first chimeric polypeptide.

Embodiment E18. The multi-chain chimeric polypeptide of any one of embodiments E1-E17, wherein the second chimeric polypeptide further comprises a peptide tag at the N-terminal end or the C-terminal end of the second chimeric polypeptide.

Embodiment E19. The multi-chain chimeric polypeptide of any one of embodiments E1-E18, wherein the first chimeric polypeptide and/or the second chimeric polypeptide further comprises a signal sequence at its N-terminal end.

Embodiment E20. The multi-chain chimeric polypeptide of embodiment E19, wherein the signal sequence comprises SEQ ID NO: 117.

Embodiment E21. The multi-chain chimeric polypeptide of embodiment E20, wherein the signal sequence is SEQ ID NO: 117.

Embodiment E22. The multi-chain chimeric polypeptide of any one of embodiments E1-E21, wherein the pair of affinity domains is a sushi domain from an alpha chain of human IL-15 receptor (IL-15Rα and a soluble IL-15.

Embodiment E23. The multi-chain chimeric polypeptide of embodiment E22, wherein the soluble IL-15 has a D8N or D8A amino acid substitution.

Embodiment E24. The multi-chain chimeric polypeptide of embodiment E22, wherein the soluble IL-15 comprises a sequence that is 80% identical to SEQ ID NO: 82.

Embodiment E25. The multi-chain chimeric polypeptide of embodiment E24, wherein the soluble IL-15 comprises a sequence that is 90% identical to SEQ ID NO: 82.

Embodiment E26. The multi-chain chimeric polypeptide of embodiment E25, wherein the soluble IL-15 comprises a sequence that is 95% identical to SEQ ID NO: 82.

Embodiment E27. The multi-chain chimeric polypeptide of embodiment E26, wherein the soluble IL-15 comprises SEQ ID NO: 82.

Embodiment E28. The multi-chain chimeric polypeptide of any one of embodiments E22-E27, wherein the sushi domain of IL-15Rα comprises a sushi domain from human IL-15Rα.

Embodiment E29. The multi-chain chimeric polypeptide of embodiment E28, wherein the sushi domain from human IL-15Rα comprises a sequence that is 80% identical to SEQ ID NO: 113.

Embodiment E30. The multi-chain chimeric polypeptide of embodiment E29, wherein the sushi domain from human IL-15Rα comprises a sequence that is 90% identical to SEQ ID NO: 113.

Embodiment E31. The multi-chain chimeric polypeptide of embodiment E30, wherein the sushi domain from human IL-15Rα comprises a sequence that is 95% identical to SEQ ID NO: 113.

Embodiment E32. The multi-chain chimeric polypeptide of embodiment E31, wherein the sushi domain from human IL-15Rα comprises SEQ ID NO: 113.

Embodiment E33. The multi-chain chimeric polypeptide of embodiment E28, wherein the sushi domain from human IL-15Rα is a mature full-length IL-15Rα.

Embodiment E34. The multi-chain chimeric polypeptide of any one of embodiments E1-E21, wherein the pair of affinity domains is selected from the group consisting of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25.

Embodiment E35. The multi-chain chimeric polypeptide of any one of embodiments E1-E34, wherein one or both of the first target-binding domain and the second target-binding domain is an antigen-binding domain.

Embodiment E36. The multi-chain chimeric polypeptide of embodiment E35, wherein the first target-binding domain and the second target-binding domain are antigen-binding domains.

Embodiment E37. The multi-chain chimeric polypeptide of embodiment E35 or E36, wherein antigen-binding domain comprises a scFv or single-domain antibody.

Embodiment E38. The multi-chain chimeric polypeptide of any one of embodiments E1-E34, wherein one or both of the first target-binding domain and the second target-binding domain is a soluble IL-21 or a soluble TGFβRII.

Embodiment E39. The multi-chain chimeric polypeptide of any one of embodiments E1-E38, wherein the first target-binding domain and the second target-binding domain both bind specifically to a receptor of IL-21 or a ligand of TGFβRII.

Embodiment E40. The multi-chain chimeric polypeptide of embodiment E39, wherein the first target-binding domain and the second target-binding domain bind specifically to the same epitope.

Embodiment E41. The multi-chain chimeric polypeptide of embodiment E40, wherein the first target-binding domain and the second target-binding domain comprise the same amino acid sequence.

Embodiment E42. The multi-chain chimeric polypeptide of any one of embodiments E1-E38, wherein the first target-binding domain binds specifically to a ligand of TGFβRII, and the second target-binding domain binds specifically to a receptor for IL-21.

Embodiment E43. The multi-chain chimeric polypeptide of any one of embodiments E1-E38, wherein the first target-binding domain binds specifically to a receptor for IL-21, and the second target-binding domain bind specifically to a ligand of TGFβRII.

Embodiment E44. The multi-chain chimeric polypeptide of embodiment E43, wherein the first target-binding domain comprises a soluble IL-21.

Embodiment E45. The multi-chain chimeric polypeptide of embodiment E44, wherein the soluble IL-21 is a soluble human IL-21.

Embodiment E46. The multi-chain chimeric polypeptide of embodiment E45, wherein the soluble human IL-21 comprises a sequence at least 80% identical to SEQ ID NO: 83.

Embodiment E47. The multi-chain chimeric polypeptide of embodiment E46, wherein the soluble human IL-21 comprises a sequence at least 90% identical to SEQ ID NO: 83.

Embodiment E48. The multi-chain chimeric polypeptide of embodiment E47, wherein the soluble human IL-21 comprises a sequence at least 95% identical to SEQ ID NO: 83.

Embodiment E49. The multi-chain chimeric polypeptide of embodiment E48, wherein the soluble human IL-21 comprises a sequence of SEQ ID NO: 83.

Embodiment E50. The multi-chain chimeric polypeptide of any one of embodiments E43-E49, wherein the second target-binding domain comprises a soluble TGFβRII.

Embodiment E51. The multi-chain chimeric polypeptide of embodiment E50, wherein the soluble TGFβRII is a soluble human TGFβRII.

Embodiment E52. The multi-chain chimeric polypeptide of embodiment E51, wherein the soluble human TGFβRII comprises a first sequence of soluble human TGFβRII and a second sequence of soluble human TGFβRII.

Embodiment E53. The multi-chain chimeric polypeptide of embodiment E52, wherein the soluble human TGFβRII further comprises a linker sequence between the first sequence of soluble human TGFβRII and the second sequence of soluble human TGFβRII.

Embodiment E54. The multi-chain chimeric polypeptide of embodiment E53, wherein the linker sequence comprises SEQ ID NO: 102.

Embodiment E55. The multi-chain chimeric polypeptide of any one of embodiments E52-E54, wherein the first sequence of soluble human TGFβRII comprises a sequence that is at least 80% identical to SEQ ID NO: 183.

Embodiment E56. The multi-chain chimeric polypeptide of embodiment E55, wherein the first sequence of soluble human TGFβRII comprises a sequence that is at least 90% identical to SEQ ID NO: 183.

Embodiment E57. The multi-chain chimeric polypeptide of embodiment E56, wherein the first sequence of soluble human TGFβRII comprises a sequence that is at least 95% identical to SEQ ID NO: 183.

Embodiment E58. The multi-chain chimeric polypeptide of embodiment E57, wherein the first sequence of soluble human TGFβRII comprises SEQ ID NO: 183.

Embodiment E59. The multi-chain chimeric polypeptide of any one of embodiments E52-E58, wherein the second sequence of soluble human TGFβRII comprises a sequence that is at least 80% identical to SEQ ID NO: 184.

Embodiment E60. The multi-chain chimeric polypeptide of embodiment E59, wherein the second sequence of soluble human TGFβRII comprises a sequence that is at least 90% identical to SEQ ID NO: 184.

Embodiment E61. The mule-chain chimeric polypeptide of embodiment E60, wherein the second sequence of soluble human TGFβRII comprises a sequence that is at least 95% identical to SEQ ID NO: 184.

Embodiment E62. The multi-chain chimeric polypeptide of embodiment E61, wherein the second sequence of soluble human TGFβRII comprises SEQ ID NO: 184.

Embodiment E63. The multi-chain chimeric polypeptide of embodiment E1, wherein the first chimeric polypeptide comprises a sequence that is at least 80% identical to SEQ ID NO: 189.

Embodiment E64. The multi-chain chimeric polypeptide of embodiment E63, wherein the first chimeric polypeptide comprises a sequence that is at least 90% identical to SEQ ID NO: 189.

Embodiment E65. The multi-chain chimeric polypeptide of embodiment E64, wherein the first chimeric polypeptide comprises a sequence that is at least 95% identical to SEQ ID NO: 189.

Embodiment E66. The multi-chain chimeric polypeptide of embodiment E65, wherein the first chimeric polypeptide comprises SEQ ID NO: 189.

Embodiment E67. The multi-chain chimeric polypeptide of embodiment E66, wherein the first chimeric polypeptide comprises SEQ ID NO: 191.

Embodiment E68. The multi-chain chimeric polypeptide of any one of embodiments E1 and E63-E67, wherein the second chimeric polypeptide comprises a sequence that is at least 80% identical to SEQ ID NO: 193.

Embodiment E69. The multi-chain chimeric polypeptide of embodiment E68, wherein the second chimeric polypeptide comprises a sequence that is at least 90% identical to SEQ ID NO: 193.

Embodiment E70. The multi-chain chimeric polypeptide of embodiment E69, wherein the second chimeric polypeptide comprises a sequence that is at least 95% identical to SEQ ID NO: 193.

Embodiment E71. The multi-chain chimeric polypeptide of embodiment E70, wherein the second chimeric polypeptide comprises SEQ ID NO: 193.

Embodiment E72. The multi-chain chimeric polypeptide of embodiment E71, wherein the second chimeric polypeptide comprises SEQ ID NO: 195.

Embodiment E73. The multi-chain chimeric polypeptide of any one of embodiments E1-E62, wherein the first chimeric polypeptide further comprises one or more additional target-binding domain(s), where at least one of the one or more additional antigen-binding domain(s) is positioned between the soluble tissue factor domain and the first domain of the pair of affinity domains.

Embodiment E74. The multi-chain chimeric polypeptide of embodiment E73, wherein the first chimeric polypeptide further comprises a linker sequence between the soluble tissue factor domain and the at least one of the one or more additional antigen-binding domain(s), and/or a linker sequence between the at least one of the one or more additional antigen-binding domain(s) and the first domain of the pair of affinity domains.

Embodiment E75. The multi-chain chimeric polypeptide of any one of embodiments E1-E62, wherein the first chimeric polypeptide further comprises one or more additional target-binding domains at the N-terminal and/or C-terminal end of the first chimeric polypeptide.

Embodiment E76. The multi-chain chimeric polypeptide of embodiment E75, wherein at least one of the one or more additional target-binding domains directly abuts the first domain of the pair of affinity domains in the first chimeric polypeptide.

Embodiment E77. The multi-chain chimeric polypeptide of embodiment E75, wherein the first chimeric polypeptide further comprises a linker sequence between the at least one of the one or more additional target-binding domains and the first domain of the pair of affinity domains.

Embodiment E78. The multi-chain chimeric polypeptide of embodiment E75, wherein the at least one of the one or more additional target-binding domains directly abuts the first target-binding domain in the first chimeric polypeptide.

Embodiment E79. The multi-chain chimeric polypeptide of embodiment E75, wherein the first chimeric polypeptide further comprises a linker sequence between the at least one of the one or more additional target-binding domains and the first target-binding domain.

Embodiment E80. The multi-chain chimeric polypeptide of embodiment E75, wherein at least one of the one or more additional target-binding domains is disposed at the N- and/or C-terminus of the first chimeric polypeptide, and at least one of the one or more additional target-binding domains is positioned between the soluble tissue factor domain and the first domain of the pair of affinity domains in the first chimeric polypeptide.

Embodiment E81. The multi-chain chimeric polypeptide of embodiment E80, wherein the at least one additional target-binding domain of the one or more additional target-binding domains disposed at the N-terminus directly abuts the first target-binding domain or the first domain of the pair of affinity domains in the first chimeric polypeptide.

Embodiment E82. The multi-chain chimeric polypeptide of embodiment E80, wherein the first chimeric polypeptide further comprises a linker sequence disposed between the at least one additional target-binding domain and the first target-binding domain or the first domain of the pair of affinity domains in the first chimeric polypeptide.

Embodiment E83. The multi-chain chimeric polypeptide of embodiment E80, wherein the at least one additional target-binding domain of the one or more additional target-binding domains disposed at the C-terminus directly abuts the first target-binding domain or the first domain of the pair of affinity domains in the first chimeric polypeptide.

Embodiment E84. The multi-chain chimeric polypeptide of embodiment E80, wherein the first chimeric polypeptide further comprises a linker sequence disposed between the at least one additional target-binding domain and the first target-binding domain or the first domain of the pair of affinity domains in the first chimeric polypeptide.

Embodiment E85. The multi-chain chimeric polypeptide of embodiment E80, wherein the at least one of the one or more additional target-binding domains positioned between the soluble tissue factor domain and the first domain of the pair of affinity domains, directly abuts the soluble tissue factor domain and/or the first domain of the pair of affinity domains.

Embodiment E86. The multi-chain chimeric polypeptide of embodiment E80, wherein the first chimeric polypeptide further comprises a linker sequence disposed (i) between the soluble tissue factor domain and the at least one of the one or more additional target-binding domains positioned between the soluble tissue factor domain and the first domain of the pair of affinity domains, and/or (ii) between the first domain of the pair of affinity domains and the at least one of the one or more additional target-binding domains positioned between the soluble tissue factor domain and the first domain of the pair of affinity domains.

Embodiment E87. The multi-chain chimeric polypeptide of any one of embodiments E1-E62 and E73-E86, wherein the second chimeric polypeptide further comprises one or more additional target-binding domains at the N-terminal end or the C-terminal end of the second chimeric polypeptide.

Embodiment E88. The multi-chain chimeric polypeptide of embodiment E87, wherein at least one of the one or more additional target-binding domains directly abuts the second domain of the pair of affinity domains in the second chimeric polypeptide.

Embodiment E89. The multi-chain chimeric polypeptide of embodiment E87, wherein the second chimeric polypeptide further comprises a linker sequence between at least one of the one or more additional target-binding domains and the second domain of the pair of affinity domains in the second chimeric polypeptide.

Embodiment E90. The multi-chain chimeric polypeptide of embodiment E87, wherein at least one of the one or more additional target-binding domains directly abuts the second target-binding domain in the second chimeric polypeptide.

Embodiment E91. The multi-chain chimeric polypeptide of embodiment E87, wherein the second chimeric polypeptide further comprises a linker sequence between at least one of the one or more additional target-binding domains and the second target-binding domain in the second chimeric polypeptide.

Embodiment E92. The multi-chain chimeric polypeptide of any one of embodiments E73-E91, wherein two or more of the first target-binding domain, the second target-binding domain, and the one or more additional target-binding domains bind specifically to the same antigen.

Embodiment E93. The multi-chain chimeric polypeptide of embodiment E92, wherein two or more of the first target-binding domain, the second target-binding domain, and the one or more additional target-binding domains bind specifically to the same epitope.

Embodiment E94. The multi-chain chimeric polypeptide of embodiment E93, wherein two or more of the first target-binding domain, the second target-binding domain, and the one or more additional target-binding domains comprise the same amino acid sequence.

Embodiment E95. The multi-chain chimeric polypeptide of any one of embodiments E73-E91, wherein the first target-binding domain, the second target-binding domain, and the one or more additional target-binding domains bind specifically to different antigens.

Embodiment E96. The multi-chain chimeric polypeptide of any one of embodiments E73-E95, wherein the one or more additional antigen-binding domains bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-D, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD28.

Embodiment E97. The multi-chain chimeric polypeptide of any one of embodiments E73-E95, wherein the one or more additional target-binding domains is a soluble interleukin or cytokine protein.

Embodiment E98. The multi-chain chimeric polypeptide of embodiment E97, wherein the soluble interleukin, cytokine, or ligand protein is selected from the group consisting of: IL-1, IL-2, IL-3, IL-7, IL-8, IL-10, IL-12, IL-15, IL-17, IL-18, IL-21, PDGF-DD, SCF, FLT3L, MICA, MICB, and a ULP16-binding protein.

Embodiment E99. The multi-chain chimeric polypeptide of any one of embodiments E73-E95, wherein the one or more additional target-binding domains is a soluble interleukin or cytokine receptor.

Embodiment E100. The multi-chain chimeric polypeptide of embodiment E99, wherein the soluble receptor is a soluble TGF-β receptor II (TGF-β RII), a soluble TGF-βRIII, a soluble NKG2D, a soluble NKp30, a soluble NKp44, a soluble NKp46, a soluble DNAM1, a scMHCI, a scMHCII, a scTCR, a soluble CD155, or a soluble CD28.

Embodiment E101. A composition comprising any of the multi-chain chimeric polypeptides of embodiments E1-E100.

Embodiment E102. The composition of embodiment E101, wherein the composition is a pharmaceutical composition.

Embodiment E103. A kit comprising at least one dose of the composition of embodiment E101 or E102.

Embodiment E104. Nucleic acid encoding any of the multi-chain chimeric polypeptides of any one of embodiments E1-E100.

Embodiment E105. A vector comprising the nucleic acid of embodiment E104.

Embodiment E106. The vector of embodiment E105, wherein the vector is an expression vector.

Embodiment E107. A cell comprising the nucleic acid of embodiment C104 or the vector of embodiment E105 or E106.

Embodiment E108. A method of producing a multi-chain chimeric polypeptide, the method comprising:
    culturing the cell of embodiment E107 in a culture medium under conditions sufficient to result in the production of the multi-chain chimeric polypeptide; and
    recovering the multi-chain chimeric polypeptide from the cell and/or the culture medium.

Embodiment E109. A multi-chain chimeric polypeptide produced by the method of embodiment E108.

Embodiment E110. The multi-chain chimeric polypeptide of embodiment E12, wherein the soluble human tissue factor domain comprises a sequence that is at least 80% identical to SEQ ID NO: 97.

Embodiment E111. The multi-chain chimeric polypeptide of embodiment E110, wherein the soluble human tissue factor domain comprises a sequence that is at least 90% identical to SEQ ID NO: 97.

Embodiment E112. The multi-chain chimeric polypeptide of embodiment E111, wherein the soluble human tissue factor domain comprises a sequence that is at least 95% identical to SEQ ID NO: 97.

Embodiment E113. The multi-chain chimeric polypeptide of embodiment E112, wherein the soluble human tissue factor domain comprises a sequence that is 100% identical to SEQ ID NO: 97.

Embodiment E114. The multi-chain chimeric polypeptide of embodiment E12, wherein the soluble human tissue factor domain comprises a sequence that is at least 80% identical to SEQ ID NO: 98.

Embodiment E115. The multi-chain chimeric polypeptide of embodiment E114, wherein the soluble human tissue factor domain comprises a sequence that is at least 90% identical to SEQ ID NO: 98.

Embodiment E116. The multi-chain chimeric polypeptide of embodiment E115, wherein the soluble human tissue factor domain comprises a sequence that is at least 95% identical to SEQ ID NO: 98.

Embodiment E117. The multi-chain chimeric polypeptide of embodiment E116, wherein the soluble human tissue factor domain comprises a sequence that is 100% identical to SEQ ID NO: 98.

Embodiment F1. A multi-chain chimeric polypeptide comprising:
 (c) a first chimeric polypeptide comprising:
  (i) a first target-binding domain;
  (ii) a soluble tissue factor domain; and
  (iii) a first domain of a pair of affinity domains;
 (d) a second chimeric polypeptide comprising:
  (i) a second domain of a pair of affinity domains; and
  (ii) a second target-binding domain,
 wherein:
  the first chimeric polypeptide and the second chimeric polypeptide associate through the binding of the first domain and the second domain of the pair of affinity domains;
  the first target-binding domain and the second targeting-binding domain each independently bind specifically to a receptor of IL-21 or a receptor of IL-7.

Embodiment F2. The multi-chain chimeric polypeptide of embodiment F1, wherein the first target-binding domain and the soluble tissue factor domain directly abut each other in the first chimeric polypeptide.

Embodiment F3. The multi-chain chimeric polypeptide of embodiment F1, wherein the first chimeric polypeptide further comprises a linker sequence between the first target-binding domain and the soluble tissue factor domain in the first chimeric polypeptide.

Embodiment F4. The multi-chain chimeric polypeptide of any one of embodiments F1-F3, wherein the soluble tissue factor domain and the first domain of the pair of affinity domains directly abut each other in the first chimeric polypeptide.

Embodiment F5. The multi-chain chimeric polypeptide of any one of embodiments F1-F3, wherein the first chimeric polypeptide further comprises a linker sequence between the soluble tissue factor domain and the first domain of the pair of affinity domains in the first chimeric polypeptide.

Embodiment F6. The multi-chain chimeric polypeptide of any one of embodiments F1-F5, wherein the second domain of the pair of affinity domains and the second target-binding domain directly abut each other in the second chimeric polypeptide.

Embodiment F7. The multi-chain chimeric polypeptide of any one of embodiments F1-F5, wherein second chimeric polypeptide further comprises a linker sequence between the second domain of the pair of affinity domains and the second target-binding domain in the second chimeric polypeptide.

Embodiment F8. The multi-chain chimeric polypeptide of any one of embodiments F1-F7, wherein the soluble tissue factor domain is a soluble human tissue factor domain.

Embodiment F9. The multi-chain chimeric polypeptide of embodiment F8, wherein the soluble human tissue factor domain comprises a sequence that is at least 80% identical to SEQ ID NO: 93.

Embodiment F10. The multi-chain chimeric polypeptide of embodiment F9, wherein the soluble human tissue factor domain comprises a sequence that is at least 90% identical to SEQ ID NO: 93.

Embodiment F11. The multi-chain chimeric polypeptide of embodiment F10, wherein the soluble human tissue factor domain comprises a sequence that is at least 95% identical to SEQ ID NO: 93.

Embodiment F12. The multi-chain chimeric polypeptide of embodiment F11, wherein the soluble human tissue factor domain comprises SEQ ID NO: 93.

Embodiment F13. The multi-chain chimeric polypeptide of embodiment F8, wherein the soluble human tissue factor domain comprises a sequence that is at least 80% identical to SEQ ID NO: 97.

Embodiment F14. The multi-chain chimeric polypeptide of embodiment F13, wherein the soluble human tissue factor domain comprises a sequence that is at least 90% identical to SEQ ID NO: 97.

Embodiment F15. The multi-chain chimeric polypeptide of embodiment F14, wherein the soluble human tissue factor domain comprises a sequence that is at least 95% identical to SEQ ID NO: 97.

Embodiment F16. The multi-chain chimeric polypeptide of embodiment F15, wherein the soluble human tissue factor domain comprises SEQ ID NO: 97.

Embodiment F17. The multi-chain chimeric polypeptide of embodiment F8, wherein the soluble human tissue factor domain comprises a sequence that is at least 80% identical to SEQ ID NO: 98.

Embodiment F18. The multi-chain chimeric polypeptide of embodiment F17, wherein the soluble human tissue factor domain comprises a sequence that is at least 90% identical to SEQ ID NO: 98.

Embodiment F19. The multi-chain chimeric polypeptide of embodiment F18, wherein the soluble human tissue factor domain comprises a sequence that is at least 95% identical to SEQ ID NO: 98.

Embodiment F20. The multi-chain chimeric polypeptide of embodiment F19, wherein the soluble human tissue factor domain comprises SEQ ID NO: 98.

Embodiment F21. The multi-chain chimeric polypeptide of any one of embodiments F8-F11, F13-F15, and F17-F19, wherein the soluble human tissue factor domain does not comprise one or more of:
 a lysine at an amino acid position that corresponds to amino acid position 20 of mature wildtype human tissue factor protein;
 an isoleucine at an amino acid position that corresponds to amino acid position 22 of mature wildtype human tissue factor protein;
 a tryptophan at an amino acid position that corresponds to amino acid position 45 of mature wildtype human tissue factor protein;
 an aspartic acid at an amino acid position that corresponds to amino acid position 58 of mature wildtype human tissue factor protein;

a tyrosine at an amino acid position that corresponds to amino acid position 94 of mature wildtype human tissue factor protein;

an arginine at an amino acid position that corresponds to amino acid position 135 of mature wildtype human tissue factor protein; and a phenylalanine at an amino acid position that corresponds to amino acid position 140 of mature wildtype human tissue factor protein.

Embodiment F22. The multi-chain chimeric polypeptide of embodiment F21, wherein the soluble human tissue factor domain does not comprise any of:

a lysine at an amino acid position that corresponds to amino acid position 20 of mature wildtype human tissue factor protein;

an isoleucine at an amino acid position that corresponds to amino acid position 22 of mature wildtype human tissue factor protein;

a tryptophan at an amino acid position that corresponds to amino acid position 45 of mature wildtype human tissue factor protein;

an aspartic acid at an amino acid position that corresponds to amino acid position 58 of mature wildtype human tissue factor protein;

a tyrosine at an amino acid position that corresponds to amino acid position 94 of mature wildtype human tissue factor protein;

an arginine at an amino acid position that corresponds to amino acid position 135 of mature wildtype human tissue factor protein; and a phenylalanine at an amino acid position that corresponds to amino acid position 140 of mature wildtype human tissue factor protein.

Embodiment F23. The multi-chain chimeric polypeptide of any one of embodiments F1-F22, wherein the soluble tissue factor domain is not capable of binding to Factor VIIa.

Embodiment F24. The multi-chain chimeric polypeptide of any one of embodiments F1-F23, wherein the soluble tissue factor domain does not convert inactive Factor X into Factor Xa.

Embodiment F25. The multi-chain chimeric polypeptide of any one of embodiments F1-F24, wherein the multi-chain chimeric polypeptide does not stimulate blood coagulation in a mammal.

Embodiment F26. The multi-chain chimeric polypeptide of any one of embodiments F1-F25, wherein the first chimeric polypeptide further comprises a peptide tag at the N-terminal end or the C-terminal end of the first chimeric polypeptide.

Embodiment F27. The multi-chain chimeric polypeptide of any one of embodiments F1-F26, wherein the second chimeric polypeptide further comprises a peptide tag at the N-terminal end or the C-terminal end of the second chimeric polypeptide.

Embodiment F28. The multi-chain chimeric polypeptide of any one of embodiments F1-F27, wherein the first chimeric polypeptide and/or the second chimeric polypeptide further comprises a signal sequence at its N-terminal end.

Embodiment F29. The multi-chain chimeric polypeptide of embodiment F28, wherein the signal sequence comprises SEQ ID NO: 117.

Embodiment F30. The multi-chain chimeric polypeptide of embodiment F28, wherein the signal sequence is SEQ ID NO: 328.

Embodiment F31. The multi-chain chimeric polypeptide of any one of embodiments F1-F30, wherein the pair of affinity domains is a sushi domain from an alpha chain of human IL-15 receptor (IL-15Rα) and a soluble IL-15.

Embodiment F32. The multi-chain chimeric polypeptide of embodiment F31, wherein the soluble IL-15 has a D8N or D8A amino acid substitution.

Embodiment F33. The multi-chain chimeric polypeptide of embodiment F31, wherein the soluble IL-15 comprises a sequence that is at least 80% identical to SEQ ID NO: 82.

Embodiment F34. The multi-chain chimeric polypeptide of embodiment F33, wherein the soluble IL-15 comprises a sequence that is at least 90% identical to SEQ ID NO: 82.

Embodiment F35. The multi-chain chimeric polypeptide of embodiment F34, wherein the soluble IL-15 comprises a sequence that is at least 95% identical to SEQ ID NO: 82.

Embodiment F36. The multi-chain chimeric polypeptide of embodiment F35, wherein the soluble IL-15 comprises SEQ ID NO: 82.

Embodiment F37. The multi-chain chimeric polypeptide of any one of embodiments F31-F36, wherein the sushi domain of IL-15Rα comprises a sushi domain from human IL-15Rα.

Embodiment F38. The multi-chain chimeric polypeptide of embodiment F37, wherein the sushi domain from human IL-15Rα comprises a sequence that is at least 80% identical to SEQ ID NO: 113.

Embodiment F39. The multi-chain chimeric polypeptide of embodiment F38, wherein the sushi domain from human IL-15Rα comprises a sequence that is at least 90% identical to SEQ ID NO: 113.

Embodiment F40. The multi-chain chimeric polypeptide of embodiment F39, wherein the sushi domain from human IL-15Rα comprises a sequence that is at least 95% identical to SEQ ID NO: 113.

Embodiment F41. The multi-chain chimeric polypeptide of embodiment F40, wherein the sushi domain from human IL-15Rα comprises SEQ ID NO: 113.

Embodiment F42. The multi-chain chimeric polypeptide of embodiment F37, wherein the sushi domain from human IL-15Rα is a mature full-length IL-15Rα.

Embodiment F43. The multi-chain chimeric polypeptide of any one of embodiments F1-F30, wherein the pair of affinity domains is selected from the group consisting of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25.

Embodiment F44. The multi-chain chimeric polypeptide of any one of embodiments F1-F43, wherein one or both of the first target-binding domain and the second target-binding domain is an agonistic antigen-binding domain.

Embodiment F45. The multi-chain chimeric polypeptide of embodiment F44, wherein the first target-binding domain and the second target-binding domain are each agonistic antigen-binding domains.

Embodiment F46. The multi-chain chimeric polypeptide of embodiment F44 or F45, wherein antigen-binding domain comprises a scFv or single-domain antibody.

Embodiment F47. The multi-chain chimeric polypeptide of any one of embodiments F1-F43, wherein one or both of the first target-binding domain and the second target-binding domain is a soluble IL-21 or a soluble IL-7.

Embodiment F48. The multi-chain chimeric polypeptide of embodiment F47, wherein the first target-binding domain and the second target-binding domain are each independently a soluble IL-21 or a soluble IL-7.

Embodiment F49. The multi-chain chimeric polypeptide of any one of embodiments F1-F48, wherein the first target-binding domain and the second target-binding domain both bind specifically to a receptor of IL-21 or a receptor of IL-7.

Embodiment F50. The multi-chain chimeric polypeptide of embodiment F49, wherein the first target-binding domain and the second target-binding domain bind specifically to the same epitope.

Embodiment F51. The multi-chain chimeric polypeptide of embodiment F50, wherein the first target-binding domain and the second target-binding domain comprise the same amino acid sequence.

Embodiment F52. The multi-chain chimeric polypeptide of any one of embodiments F1-F48, wherein the first target-binding domain binds specifically to a receptor for IL-21, and the second target-binding domain binds specifically to a receptor for IL-7.

Embodiment F53. The multi-chain chimeric polypeptide of any one of embodiments F1-F48, wherein the first target-binding domain binds specifically to a receptor for IL-7, and the second target-binding domain bind specifically to a receptor for IL-21.

Embodiment F54. The multi-chain chimeric polypeptide of embodiment F53, wherein the first target-binding domain comprises a soluble IL-21.

Embodiment F55. The multi-chain chimeric polypeptide of embodiment F54, wherein the soluble IL-21 is a soluble human IL-21.

Embodiment F56. The multi-chain chimeric polypeptide of embodiment F55, wherein the soluble human IL-21 comprises a sequence at least 80% identical to SEQ ID NO: 83.

Embodiment F57. The multi-chain chimeric polypeptide of embodiment F56, wherein the soluble human IL-21 comprises a sequence at least 90% identical to SEQ ID NO: 83.

Embodiment F58. The multi-chain chimeric polypeptide of embodiment F57, wherein the soluble human IL-21 comprises a sequence at least 95% identical to SEQ ID NO: 83.

Embodiment F59. The multi-chain chimeric polypeptide of embodiment F58, wherein the soluble human IL-21 comprises a sequence of SEQ ID NO: 83.

Embodiment F60. The multi-chain chimeric polypeptide of any one of embodiments F53-F59, wherein the second target-binding domain comprises a soluble IL-7.

Embodiment F61. The multi-chain chimeric polypeptide of embodiment D60, wherein the soluble IL-7 is a soluble human IL-7.

Embodiment F62. The multi-chain chimeric polypeptide of embodiment F61, wherein the soluble human IL-7 comprises a sequence at least 80% identical to SEQ ID NO: 79.

Embodiment F63. The multi-chain chimeric polypeptide of embodiment F62, wherein the soluble human IL-7 comprises a sequence at least 90% identical to SEQ ID NO: 79.

Embodiment F64. The multi-chain chimeric polypeptide of embodiment F63, wherein the soluble human IL-7 comprises a sequence at least 95% identical to SEQ ID NO: 79.

Embodiment F65. The multi-chain chimeric polypeptide of embodiment F64, wherein the soluble human IL-7 comprises a sequence of SEQ ID NO: 79.

Embodiment F66. The multi-chain chimeric polypeptide of embodiment F1, wherein the first chimeric polypeptide comprises a sequence that is at least 80% identical to SEQ ID NO: 207.

Embodiment F67. The multi-chain chimeric polypeptide of embodiment F66, wherein the first chimeric polypeptide comprises a sequence that is at least 90% identical to SEQ ID NO: 207.

Embodiment F68. The multi-chain chimeric polypeptide of embodiment F67, wherein the first chimeric polypeptide comprises a sequence that is at least 95% identical to SEQ ID NO: 207.

Embodiment F69. The multi-chain chimeric polypeptide of embodiment F68, wherein the first chimeric polypeptide comprises SEQ ID NO: 207.

Embodiment F70. The multi-chain chimeric polypeptide of embodiment F69, wherein the first chimeric polypeptide comprises SEQ ID NO: 209.

Embodiment F71. The multi-chain chimeric polypeptide of any one of embodiments F1 and F66-F70, wherein the second chimeric polypeptide comprises a sequence that is at least 80% identical to SEQ ID NO: 211.

Embodiment F72. The multi-chain chimeric polypeptide of embodiment F71, wherein the second chimeric polypeptide comprises a sequence that is at least 90% identical to SEQ ID NO: 211.

Embodiment F73. The multi-chain chimeric polypeptide of embodiment F72, wherein the second chimeric polypeptide comprises a sequence that is at least 95% identical to SEQ ID NO: 211.

Embodiment F74. The multi-chain chimeric polypeptide of embodiment F73, wherein the second chimeric polypeptide comprises SEQ ID NO: 211.

Embodiment F75. The multi-chain chimeric polypeptide of embodiment F74, wherein the second chimeric polypeptide comprises SEQ ID NO: 213.

Embodiment F76. The multi-chain chimeric polypeptide of embodiment F1, wherein the first chimeric polypeptide comprises a sequence that is at least 80% identical to SEQ ID NO: 199.

Embodiment F77. The multi-chain chimeric polypeptide of embodiment F76, wherein the first chimeric polypeptide comprises a sequence that is at least 90% identical to SEQ ID NO: 199.

Embodiment F78. The multi-chain chimeric polypeptide of embodiment F77, wherein the first chimeric polypeptide comprises a sequence that is at least 95% identical to SEQ ID NO: 199.

Embodiment F79. The multi-chain chimeric polypeptide of embodiment F68, wherein the first chimeric polypeptide comprises SEQ ID NO: 199.

Embodiment F80. The multi-chain chimeric polypeptide of embodiment F69, wherein the first chimeric polypeptide comprises SEQ ID NO: 201.

Embodiment F81. The multi-chain chimeric polypeptide of any one of embodiments F1 and F76-F80, wherein the second chimeric polypeptide comprises a sequence that is at least 80% identical to SEQ ID NO: 203.

Embodiment F82. The multi-chain chimeric polypeptide of embodiment F81, wherein the second chimeric polypeptide comprises a sequence that is at least 90% identical to SEQ ID NO: 203.

Embodiment F83. The multi-chain chimeric polypeptide of embodiment F82, wherein the second chimeric polypeptide comprises a sequence that is at least 95% identical to SEQ ID NO: 203.

Embodiment F84. The multi-chain chimeric polypeptide of embodiment F83, wherein the second chimeric polypeptide comprises SEQ ID NO: 203.

Embodiment F85. The multi-chain chimeric polypeptide of embodiment F84, wherein the second chimeric polypeptide comprises SEQ ID NO: 209.

Embodiment F86. The multi-chain chimeric polypeptide of any one of embodiments F1-F65, wherein the first chimeric polypeptide further comprises one or more additional target-binding domain(s), where at least one of the one or more additional antigen-binding domain(s) is positioned between the soluble tissue factor domain and the first domain of the pair of affinity domains.

Embodiment F87. The multi-chain chimeric polypeptide of embodiment F86, wherein the first chimeric polypeptide further comprises a linker sequence between the soluble tissue factor domain and the at least one of the one or more additional antigen-binding domain(s), and/or a linker sequence between the at least one of the one or more additional antigen-binding domain(s) and the first domain of the pair of affinity domains.

Embodiment F88. The multi-chain chimeric polypeptide of any one of embodiments F1-F65, wherein the first chimeric polypeptide further comprises one or more additional target-binding domains at the N-terminal and/or C-terminal end of the first chimeric polypeptide.

Embodiment F89. The multi-chain chimeric polypeptide of embodiment F88, wherein at least one of the one or more additional target-binding domains directly abuts the first domain of the pair of affinity domains in the first chimeric polypeptide.

Embodiment F90. The multi-chain chimeric polypeptide of embodiment F88, wherein the first chimeric polypeptide further comprises a linker sequence between the at least one of the one or more additional target-binding domains and the first domain of the pair of affinity domains.

Embodiment F91. The multi-chain chimeric polypeptide of embodiment F88, wherein the at least one of the one or more additional target-binding domains directly abuts the first target-binding domain in the first chimeric polypeptide.

Embodiment F92. The multi-chain chimeric polypeptide of embodiment F88, wherein the first chimeric polypeptide further comprises a linker sequence between the at least one of the one or more additional target-binding domains and the first target-binding domain.

Embodiment F93. The multi-chain chimeric polypeptide of embodiment F88, wherein at least one of the one or more additional target-binding domains is disposed at the N- and/or C-terminus of the first chimeric polypeptide, and at least one of the one or more additional target-binding domains is positioned between the soluble tissue factor domain and the first domain of the pair of affinity domains in the first chimeric polypeptide.

Embodiment F94. The multi-chain chimeric polypeptide of embodiment F93, wherein the at least one additional target-binding domain of the one or more additional target-binding domains disposed at the N-terminus directly abuts the first target-binding domain or the first domain of the pair of affinity domains in the first chimeric polypeptide.

Embodiment F95. The multi-chain chimeric polypeptide of embodiment F93, wherein the first chimeric polypeptide further comprises a linker sequence disposed between the at least one additional target-binding domain and the first target-binding domain or the first domain of the pair of affinity domains in the first chimeric polypeptide.

Embodiment F96. The multi-chain chimeric polypeptide of embodiment F93, wherein the at least one additional target-binding domain of the one or more additional target-binding domains disposed at the C-terminus directly abuts the first target-binding domain or the first domain of the pair of affinity domains in the first chimeric polypeptide.

Embodiment F97. The multi-chain chimeric polypeptide of embodiment F93, wherein the first chimeric polypeptide further comprises a linker sequence disposed between the at least one additional target-binding domain and the first target-binding domain or the first domain of the pair of affinity domains in the first chimeric polypeptide.

Embodiment F98. The multi-chain chimeric polypeptide of embodiment F93, wherein the at least one of the one or more additional target-binding domains positioned between the soluble tissue factor domain and the first domain of the pair of affinity domains, directly abuts the soluble tissue factor domain and/or the first domain of the pair of affinity domains.

Embodiment F99. The multi-chain chimeric polypeptide of embodiment F93, wherein the first chimeric polypeptide further comprises a linker sequence disposed (i) between the soluble tissue factor domain and the at least one of the one or more additional target-binding domains positioned between the soluble tissue factor domain and the first domain of the pair of affinity domains, and/or (ii) between the first domain of the pair of affinity domains and the at least one of the one or more additional target-binding domains positioned between the soluble tissue factor domain and the first domain of the pair of affinity domains.

Embodiment F100. The multi-chain chimeric polypeptide of any one of embodiments F1-F65 and F86-F99, wherein the second chimeric polypeptide further comprises one or more additional target-binding domains at the N-terminal end or the C-terminal end of the second chimeric polypeptide.

Embodiment F101. The multi-chain chimeric polypeptide of embodiment F100, wherein at least one of the one or more additional target-binding domains directly abuts the second domain of the pair of affinity domains in the second chimeric polypeptide.

Embodiment F102. The multi-chain chimeric polypeptide of embodiment F100, wherein the second chimeric polypeptide further comprises a linker sequence between at least one of the one or more additional target-binding domains and the second domain of the pair of affinity domains in the second chimeric polypeptide.

Embodiment F103. The multi-chain chimeric polypeptide of embodiment F100, wherein at least one of the one or more additional target-binding domains directly abuts the second target-binding domain in the second chimeric polypeptide.

Embodiment F104. The multi-chain chimeric polypeptide of embodiment F100, wherein the second chimeric polypeptide further comprises a linker sequence between at least one of the one or more additional target-binding domains and the second target-binding domain in the second chimeric polypeptide.

Embodiment F105. The multi-chain chimeric polypeptide of any one of embodiments F86-F104, wherein two or more of the first target-binding domain, the second target-binding domain, and the one or more additional target-binding domains bind specifically to the same antigen.

Embodiment F106. The multi-chain chimeric polypeptide of embodiment F105, wherein two or more of the first target-binding domain, the second target-binding domain, and the one or more additional target-binding domains bind specifically to the same epitope.

Embodiment F107. The multi-chain chimeric polypeptide of embodiment F106, wherein two or more of the first target-binding domain, the second target-binding domain, and the one or more additional target-binding domains comprise the same amino acid sequence.

Embodiment F108. The multi-chain chimeric polypeptide of any one of embodiments F86-F104, wherein the first target-binding domain, the second target-binding domain, and the one or more additional target-binding domains bind specifically to different antigens.

Embodiment F109. The multi-chain chimeric polypeptide of any one of embodiments F86-F108, wherein the one or more additional antigen-binding domains bind specifically to a target selected from the group consisting of: CD16a, CD28, CD3, CD33, CD20, CD19, CD22, CD123, IL-1R, IL-1, VEGF, IL-6R, IL-4, IL-10, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for IL-1, a receptor for IL-2, a receptor for IL-3, a receptor for IL-7, a receptor for IL-8, a receptor for IL-10, a receptor for IL-12, a receptor for IL-15, a receptor for IL-17, a receptor for IL-18, a receptor for IL-21, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD28.

Embodiment F110. The multi-chain chimeric polypeptide of any one of embodiments F86-F108, wherein the one or more additional target-binding domains is a soluble interleukin or cytokine protein.

Embodiment F111. The multi-chain chimeric polypeptide of embodiment F110, wherein the soluble interleukin, cytokine, or ligand protein is selected from the group consisting of: IL-1, IL-2, IL-3, IL-7, IL-8, IL-10, IL-12, IL-15, IL-17, IL-18, IL-21, PDGF-DD, SCF, FLT3L, MICA, MICB, and a ULP16-binding protein.

Embodiment F112. The multi-chain chimeric polypeptide of any one of embodiments F86-F108, wherein the one or more additional target-binding domains is a soluble interleukin or cytokine receptor.

Embodiment F113. The multi-chain chimeric polypeptide of embodiment F112, wherein the soluble receptor is a soluble TGF-β receptor II (TGF-βRII), a soluble TGF-βRIII, a soluble NKG2D, a soluble NKp30, a soluble NKp44, a soluble NKp46, a soluble DNAM1, a scMHCI, a scMHCII, a scTCR, a soluble CD155, a soluble CD122, or a soluble CD28.

Embodiment F114. A composition comprising any of the multi-chain chimeric polypeptides of embodiments F1-F113.

Embodiment F115. The composition of embodiment F114, wherein the composition is a pharmaceutical composition.

Embodiment F116. A kit comprising at least one dose of the composition of embodiment F114 or F115.

Embodiment F117. Nucleic acid encoding any of the multi-chain chimeric polypeptides of any one of embodiments F1-F113.

Embodiment F118. A vector comprising the nucleic acid of embodiment F117.

Embodiment F119. The vector of embodiment F118, wherein the vector is an expression vector.

Embodiment F120. A cell comprising the nucleic acid of embodiment F117 or the vector of embodiment F118 or F119.

Embodiment F121. A method of producing a multi-chain chimeric polypeptide, the method comprising:
    culturing the cell of embodiment F120 in a culture medium under conditions sufficient to result in the production of the multi-chain chimeric polypeptide; and
    recovering the multi-chain chimeric polypeptide from the cell and/or the culture medium.

Embodiment F122. A multi-chain chimeric polypeptide produced by the method of embodiment F121.

Embodiment G1. A multi-chain chimeric polypeptide comprising:
    (e) a first chimeric polypeptide comprising:
        (i) a first target-binding domain;
        (ii) a soluble tissue factor domain; and
        (iii) a first domain of a pair of affinity domains;
    (f) a second chimeric polypeptide comprising:
        (i) a second domain of a pair of affinity domains; and
        (ii) a second target-binding domain,
    wherein:
    the first chimeric polypeptide and the second chimeric polypeptide associate through the binding of the first domain and the second domain of the pair of affinity domains; and
    the first target-binding domain and the second targeting-binding domain each independently bind specifically to: a receptor for IL-7, CD16, a receptor for IL-21, TGF-β, or a receptor for CD137L.

Embodiment G2. The multi-chain chimeric polypeptide of embodiment G1, wherein the first target-binding domain and the soluble tissue factor domain directly abut each other in the first chimeric polypeptide.

Embodiment G3. The multi-chain chimeric polypeptide of embodiment G1, wherein the first chimeric polypeptide further comprises a linker sequence between the first target-binding domain and the soluble tissue factor domain in the first chimeric polypeptide.

Embodiment G4. The multi-chain chimeric polypeptide of any one of embodiments G1-G3, wherein the soluble tissue factor domain and the first domain of the pair of affinity domains directly abut each other in the first chimeric polypeptide.

Embodiment G5. The multi-chain chimeric polypeptide of any one of embodiments G1-G3, wherein the first chimeric polypeptide further comprises a linker sequence between the soluble tissue factor domain and the first domain of the pair of affinity domains in the first chimeric polypeptide.

Embodiment G6. The multi-chain chimeric polypeptide of any one of embodiments G1-G5, wherein the second domain of the pair of affinity domains and the second target-binding domain directly abut each other in the second chimeric polypeptide.

Embodiment G7. The multi-chain chimeric polypeptide of any one of embodiments G1-G5, wherein second chimeric polypeptide further comprises a linker sequence between the second domain of the pair of affinity domains and the second target-binding domain in the second chimeric polypeptide.

Embodiment G8. The multi-chain chimeric polypeptide of any one of embodiments G1-G7, wherein the soluble tissue factor domain is a soluble human tissue factor domain.

Embodiment G9. The multi-chain chimeric polypeptide of embodiment G8, wherein the soluble human tissue factor domain comprises a sequence that is at least 80% identical to SEQ ID NO: 93.

Embodiment G10. The multi-chain chimeric polypeptide of embodiment G9, wherein the soluble human tissue factor domain comprises a sequence that is at least 90% identical to SEQ ID NO: 93.

Embodiment G11. The multi-chain chimeric polypeptide of embodiment G10, wherein the soluble human tissue factor domain comprises a sequence that is at least 95% identical to SEQ ID NO: 93.

Embodiment G12. The multi-chain chimeric polypeptide of any one of embodiments G8-G11, wherein the soluble human tissue factor domain does not comprise one or more of:
- a lysine at an amino acid position that corresponds to amino acid position 20 of mature wildtype human tissue factor protein;
- an isoleucine at an amino acid position that corresponds to amino acid position 22 of mature wildtype human tissue factor protein;
- a tryptophan at an amino acid position that corresponds to amino acid position 45 of mature wildtype human tissue factor protein;
- an aspartic acid at an amino acid position that corresponds to amino acid position 58 of mature wildtype human tissue factor protein;
- a tyrosine at an amino acid position that corresponds to amino acid position 94 of mature wildtype human tissue factor protein;
- an arginine at an amino acid position that corresponds to amino acid position 135 of mature wildtype human tissue factor protein; and
- a phenylalanine at an amino acid position that corresponds to amino acid position 140 of mature wildtype human tissue factor protein.

Embodiment G13. The multi-chain chimeric polypeptide of embodiment G12, wherein the soluble human tissue factor domain does not comprise any of:
- a lysine at an amino acid position that corresponds to amino acid position 20 of mature wildtype human tissue factor protein;
- an isoleucine at an amino acid position that corresponds to amino acid position 22 of mature wildtype human tissue factor protein;
- a tryptophan at an amino acid position that corresponds to amino acid position 45 of mature wildtype human tissue factor protein;
- an aspartic acid at an amino acid position that corresponds to amino acid position 58 of mature wildtype human tissue factor protein;
- a tyrosine at an amino acid position that corresponds to amino acid position 94 of mature wildtype human tissue factor protein;
- an arginine at an amino acid position that corresponds to amino acid position 135 of mature wildtype human tissue factor protein; and
- a phenylalanine at an amino acid position that corresponds to amino acid position 140 of mature wildtype human tissue factor protein.

Embodiment G14. The multi-chain chimeric polypeptide of any one of embodiments G1-G13, wherein the soluble tissue factor domain is not capable of binding to Factor VIIa.

Embodiment G15. The multi-chain chimeric polypeptide of any one of embodiments G1-G14, wherein the soluble tissue factor domain does not convert inactive Factor X into Factor Xa.

Embodiment G16. The multi-chain chimeric polypeptide of any one of embodiments G1-G15, wherein the multi-chain chimeric polypeptide does not stimulate blood coagulation in a mammal.

Embodiment G17. The multi-chain chimeric polypeptide of any one of embodiments GI-G16, wherein the first chimeric polypeptide further comprises a peptide tag at the N-terminal end or the C-terminal end of the first chimeric polypeptide.

Embodiment G18. The multi-chain chimeric polypeptide of any one of embodiments G1-G17, wherein the second chimeric polypeptide further comprises a peptide tag at the N-terminal end or the C-terminal end of the second chimeric polypeptide.

Embodiment G19. The multi-chain chimeric polypeptide of any one of embodiments G1-G18, wherein the first chimeric polypeptide and/or the second chimeric polypeptide further comprises a signal sequence at its N-terminal end.

Embodiment G20. The multi-chain chimeric polypeptide of embodiment G19, wherein the signal sequence comprises SEQ ID NO: 117.

Embodiment G21. The multi-chain chimeric polypeptide of embodiment G20, wherein the signal sequence is SEQ ID NO: 117.

Embodiment G22. The multi-chain chimeric polypeptide of any one of embodiments GI-G21, wherein the pair of affinity domains is a sushi domain from an alpha chain of human IL-15 receptor (IL-15Rα) and a soluble IL-15.

Embodiment G23. The multi-chain chimeric polypeptide of embodiment G22, wherein the soluble IL-15 has a D8N or D8A amino acid substitution.

Embodiment G24. The multi-chain chimeric polypeptide of embodiment G22, wherein the soluble IL-15 comprises a sequence that is 80% identical to SEQ ID NO: 82.

Embodiment G25. The multi-chain chimeric polypeptide of embodiment G24, wherein the soluble IL-15 comprises a sequence that is 90% identical to SEQ ID NO: 82.

Embodiment G26. The multi-chain chimeric polypeptide of embodiment G25, wherein the soluble IL-15 comprises a sequence that is 95% identical to SEQ ID NO: 82.

Embodiment G27. The multi-chain chimeric polypeptide of embodiment G26, wherein the soluble IL-15 comprises SEQ ID NO: 82.

Embodiment G28. The multi-chain chimeric polypeptide of any one of embodiments G22-G27, wherein the sushi domain of IL-15Rα comprises a sushi domain from human IL-15Rα.

Embodiment G29. The multi-chain chimeric polypeptide of embodiment G28, wherein the sushi domain from human IL-15Rα comprises a sequence that is 80% identical to SEQ ID NO: 113.

Embodiment G30. The multi-chain chimeric polypeptide of embodiment G29, wherein the sushi domain from human IL-15Rα comprises a sequence that is 90% identical to SEQ ID NO: 113.

Embodiment G31. The multi-chain chimeric polypeptide of embodiment G30, wherein the sushi domain from human IL-15Rα comprises a sequence that is 95% identical to SEQ ID NO: 113.

Embodiment G32. The multi-chain chimeric polypeptide of embodiment G31, wherein the sushi domain from human IL-15Rα comprises SEQ ID NO: 113.

Embodiment G33. The multi-chain chimeric polypeptide of embodiment G28, wherein the sushi domain from human IL-15Rα is a mature full-length IL-15Rα.

Embodiment G34. The multi-chain chimeric polypeptide of any one of embodiments G1-G21, wherein the pair of affinity domains is selected from the group consisting of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25.

Embodiment G35. The multi-chain chimeric polypeptide of any one of embodiments G1-G34, wherein the first target-binding domain and the second targeting-binding domain each independently bind specifically to a receptor for IL-7, CD16, or a receptor for IL-21.

Embodiment G36. The multi-chain chimeric polypeptide of embodiment G35, wherein the first target-binding domain binds specifically to a receptor IL-7 and the second target-binding domain binds specifically to CD16 or a receptor for IL-21.

Embodiment G37. The multi-chain chimeric polypeptide of embodiment G36, wherein the first target-binding domain comprises a soluble IL-7 protein.

Embodiment G38. The multi-chain chimeric polypeptide of embodiment G37, wherein the soluble IL-7 protein is a soluble human IL-7.

Embodiment G39. The multi-chain chimeric polypeptide of any one of embodiments G36-G38, wherein the second antigen-binding domain comprises an antigen-binding domain that binds specifically to CD16.

Embodiment G40. The multi-chain chimeric polypeptide of embodiment G39, wherein the second antigen-binding domain comprises an scFv that binds specifically to CD16.

Embodiment G41. The multi-chain chimeric polypeptide of any one of embodiments G36-G38, wherein the second antigen-binding domain bind specifically to a receptor for IL-21.

Embodiment G42. The multi-chain chimeric polypeptide of embodiment G41, wherein the second antigen-binding domain comprises a soluble IL-21.

Embodiment G43. The multi-chain chimeric polypeptide of embodiment G42, wherein the soluble IL-21 is a soluble human IL-21.

Embodiment G44. The multi-chain chimeric polypeptide of any one of embodiments G36-G40, wherein the second chimeric polypeptide further comprises an additional target-binding domain that binds specifically to a receptor for IL-21.

Embodiment G45. The multi-chain chimeric polypeptide of embodiment G44, wherein the additional target-binding domain comprises a soluble IL-21.

Embodiment G46. The multi-chain chimeric polypeptide of embodiment G45, wherein the soluble IL-21 is a soluble human IL-12.

Embodiment G47. The multi-chain chimeric polypeptide of any one of embodiments G1-G34, wherein the first target-binding domain and the second targeting-binding domain each independently bind specifically to TGF-β, CD16, or a receptor for IL-21.

Embodiment G48. The multi-chain chimeric polypeptide of embodiment G47, wherein the first target-binding domain binds specifically to a TGF-β and the second target-binding domain binds specifically to CD16 or a receptor of IL-21.

Embodiment G49. The multi-specific chimeric polypeptide of embodiment G48, wherein the first target-binding domain is a soluble TGF-β receptor.

Embodiment G50. The multi-specific chimeric polypeptide of embodiment G49, wherein soluble TGF-β receptor is a soluble TGFβRII receptor.

Embodiment G51. The multi-specific chimeric polypeptide of any one of embodiments G48-G50, wherein the second target-binding domain binds specifically to CD16.

Embodiment G52. The multi-specific chimeric polypeptide of embodiment G51, wherein the second antigen-binding domain comprises an antigen-binding domain that binds specifically to CD16.

Embodiment G53. The multi-chain chimeric polypeptide of embodiment G52, wherein the second antigen-binding domain comprises an scFv that binds specifically to CD16.

Embodiment G54. The multi-chain chimeric polypeptide of any one of embodiments G48-G50, wherein the second target-binding domain binds specifically to a receptor for IL-21.

Embodiment G55. The multi-chain chimeric polypeptide of embodiment G54, wherein the second target-binding domain comprises a soluble IL-21.

Embodiment G56. The multi-chain chimeric polypeptide of embodiment G55, wherein the second target-binding domain comprises a soluble human IL-21.

Embodiment G57. The multi-chain chimeric polypeptide of any one of embodiments G48-G53, wherein the second chimeric polypeptide further comprises an additional target-binding domain that binds specifically to a receptor for IL-21.

Embodiment G58. The multi-chain chimeric polypeptide of embodiment G57, wherein the additional target-binding domain comprises a soluble IL-21.

Embodiment G59. The multi-chain chimeric polypeptide of embodiment G58, wherein the soluble IL-21 is a soluble human IL-21.

Embodiment G60. The multi-chain chimeric polypeptide of any one of embodiments G1-G34, wherein the first target-binding domain and the second target-binding domain each independently bind specifically to a receptor for IL-7.

Embodiment G61. The multi-chain chimeric polypeptide of embodiment G60, wherein the first target-binding domain and the second target-binding domain include a soluble IL-7.

Embodiment G62. The multi-chain chimeric polypeptide of embodiment G61, wherein the soluble IL-7 is a soluble human IL-7.

Embodiment G63. The multi-chain chimeric polypeptide of any one of embodiments G1-G34, wherein the first target-binding domain and the second target-binding domain each independently bind specifically to TGF-β.

Embodiment G64. The multi-specific chimeric polypeptide of embodiment G63, wherein the first target-binding domain and the second target-binding domain is a soluble TGF-β receptor.

Embodiment G65. The multi-specific chimeric polypeptide of embodiment G64, wherein the soluble TGF-β receptor is a soluble TGFβRII receptor.

Embodiment G66. The multi-specific chimeric polypeptide of any one of embodiments G1-G34, wherein the first target-binding domain and the second targeting-binding domain each independently bind specifically to a receptor for IL-7, a receptor for IL-21, or a receptor for CD137L.

Embodiment G67. The multi-chain chimeric polypeptide of embodiment G66, wherein the first target-binding domain binds specifically to a receptor for IL-7 and the second target-binding domain binds specifically to a receptor for IL-21 or a receptor for CD137L.

Embodiment G68. The multi-specific chimeric polypeptide of embodiment G67, wherein the first target-binding domain is a soluble IL-7.

Embodiment G69. The multi-specific chimeric polypeptide of embodiment G68, wherein the soluble IL-7 is a soluble human IL-7.

Embodiment G70. The multi-chain chimeric polypeptide of any one of embodiments G67-G69, wherein the second target-binding domain binds specifically to a receptor for IL-21.

Embodiment G71. The multi-chain chimeric polypeptide of embodiment G70, wherein the second target-binding domain is a soluble IL-21.

Embodiment G72. The multi-chain chimeric polypeptide of embodiment G71, wherein the soluble IL-21 is a soluble human IL-21.

Embodiment G73. The multi-chain chimeric polypeptide of any one of embodiments G67-G69, wherein the second antigen-binding domain binds specifically to a receptor for CD137L.

Embodiment G74. The multi-chain chimeric polypeptide of embodiment G73, wherein the second antigen-binding domain is a soluble CD137L.

Embodiment G75. The multi-chain chimeric polypeptide of embodiment G74, wherein the soluble CD137L is a soluble human CD137L.

Embodiment G76. The multi-chain chimeric polypeptide of any one of embodiments G67-G72, wherein the second chimeric polypeptide further comprises an additional target-binding domain that binds specifically to a receptor for CD137L.

Embodiment G77. The multi-chain chimeric polypeptide of embodiment G76, wherein the additional target-binding domain comprises a soluble CD137L.

Embodiment G78. The multi-chain chimeric polypeptide of embodiment G77, wherein the soluble CD137L is a soluble human CD137L.

Embodiment G79. The multi-chain chimeric polypeptide of any one of embodiments G1-G34, wherein the first target-binding domain and the second targeting-binding domain each independently bind specifically to a receptor for IL-7 or TGF-β.

Embodiment G80. The multi-chain chimeric polypeptide of embodiment G79, wherein the first target-binding domain binds specifically to a receptor IL-7 and the second target-binding domain binds specifically to TGF-β.

Embodiment G81. The multi-chain chimeric polypeptide of embodiment G80, wherein the first target-binding domain comprises a soluble IL-7 protein.

Embodiment G82. The multi-chain chimeric polypeptide of embodiment G81, wherein the soluble IL-7 protein is a soluble human IL-7.

Embodiment G83. The multi-chain chimeric polypeptide of any one of embodiments G80-G82, wherein the second antigen-binding domain comprises an antigen-binding domain that binds specifically to TGF-β.

Embodiment G84. The multi-specific chimeric polypeptide of embodiment G83, wherein the second target-binding domain is a soluble TGF-β receptor.

Embodiment G85. The multi-specific chimeric polypeptide of embodiment G84, wherein the soluble TGF-β receptor is a soluble TGFβRII receptor.

Embodiment G86. The multi-chain chimeric polypeptide of any one of embodiments G1-G34, wherein the first target-binding domain and the second targeting-binding domain each independently bind specifically to TGF-β, a receptor for IL-21, or a receptor for CD137L.

Embodiment G87. The multi-chain chimeric polypeptide of embodiment G86, wherein the first target-binding domain binds specifically to a TGF-β and the second target-binding domain binds specifically to a receptor for IL-21 or a receptor for CD137L.

Embodiment G88. The multi-specific chimeric polypeptide of embodiment G87, wherein the first target-binding domain is a soluble TGF-β receptor.

Embodiment G89. The multi-specific chimeric polypeptide of embodiment G88, wherein the soluble TGF-β receptor is a soluble TGFβRII receptor.

Embodiment G90. The multi-specific chimeric polypeptide of any one of embodiments G87-G89, wherein the second target-binding domain binds specifically to a receptor for IL-21.

Embodiment G91. The multi-chain chimeric polypeptide of embodiment G90, wherein the second target-binding domain comprises a soluble IL-21.

Embodiment G92. The multi-chain chimeric polypeptide of embodiment G91, wherein the second target-binding domain comprises a soluble human IL-21.

Embodiment G93. The multi-specific chimeric polypeptide of any one of embodiments G87-G89, wherein the second target-binding domain binds specifically to a receptor for CD137L.

Embodiment G94. The multi-chain chimeric polypeptide of embodiment G93, wherein the second target-binding domain comprises a soluble CD137L.

Embodiment G95. The multi-chain chimeric polypeptide of embodiment G94, wherein the second target-binding domain comprises a soluble human CD137L.

Embodiment G96. The multi-chain chimeric polypeptide of any one of embodiments G87-G92, wherein the second chimeric polypeptide further comprises an additional target-binding domain that binds specifically to a receptor for CD137L.

Embodiment G97. The multi-chain chimeric polypeptide of embodiment G96, wherein the additional target-binding domain comprises a soluble CD137L.

Embodiment G98. The multi-chain chimeric polypeptide of embodiment G97, wherein the soluble CD137L is a soluble human CD137L.

Embodiment G99. The multi-chain chimeric polypeptide of any one of embodiments G1-G34, wherein the first target-binding domain and the second targeting-binding domain each independently bind specifically to TGF-β or a receptor for IL-21.

Embodiment G100. The multi-chain chimeric polypeptide of embodiment G99, wherein the first target-binding domain binds specifically to a TGF-β and the second target-binding domain binds specifically to TGF-β or a receptor for IL-21.

Embodiment G101. The multi-specific chimeric polypeptide of embodiment G100, wherein the first target-binding domain is a soluble TGF-β receptor.

Embodiment G102. The multi-specific chimeric polypeptide of embodiment G101, wherein the soluble TGF-β receptor is a soluble TGFβRII receptor.

Embodiment G103. The multi-specific chimeric polypeptide of any one of embodiments G100-G102, wherein the second target-binding domain binds specifically to a receptor for IL-21.

Embodiment G104. The multi-chain chimeric polypeptide of embodiment G103, wherein the second target-binding domain comprises a soluble IL-21.

Embodiment G105. The multi-chain chimeric polypeptide of embodiment G104, wherein the second target-binding domain comprises a soluble human IL-21.

Embodiment G106. The multi-specific chimeric polypeptide of any one of embodiments G100-G102, wherein the second target-binding domain binds specifically to TGF-0.

Embodiment G107. The multi-specific chimeric polypeptide of embodiment G106, wherein the first target-binding domain is a soluble TGF-β receptor.

Embodiment G108. The multi-specific chimeric polypeptide of embodiment G107, wherein the soluble TGF-β receptor is a soluble TGFβRII receptor.

Embodiment G109. The multi-specific chimeric polypeptide of any one of embodiments G100-G105, wherein the second polypeptide further comprises an additional target-binding domain that binds specifically to TGF-β.

Embodiment G110. The multi-specific chimeric polypeptide of embodiment G109, wherein the first target-binding domain is a soluble TGF-β receptor.

Embodiment G111. The multi-specific chimeric polypeptide of embodiment G110, wherein the soluble TGF-β receptor is a soluble TGFβRII receptor.

Embodiment G112. The multi-chain chimeric polypeptide of any one of embodiments G1-G34, wherein the first target-binding domain and the second targeting-binding domain each independently bind specifically to TGF-β or IL-16.

Embodiment G113. The multi-chain chimeric polypeptide of embodiment G112, wherein the first target-binding domain binds specifically to a TGF-β and the second target-binding domain binds specifically to TGF-β or IL-16.

Embodiment G114. The multi-specific chimeric polypeptide of embodiment G113, wherein the first target-binding domain is a soluble TGF-β receptor.

Embodiment G115. The multi-specific chimeric polypeptide of embodiment G114, wherein the soluble TGF-β receptor is a soluble TGFβRII receptor.

Embodiment G116. The multi-specific chimeric polypeptide of any one of embodiments G113-G115, wherein the second target-binding domain binds specifically to IL-16.

Embodiment G117. The multi-specific chimeric polypeptide of embodiment G116, wherein the second antigen-binding domain comprises an antigen-binding domain that binds specifically to CD16.

Embodiment G118. The multi-chain chimeric polypeptide of embodiment G117, wherein the second antigen-binding domain comprises an scFv that binds specifically to CD16.

Embodiment G119. The multi-specific chimeric polypeptide of any one of embodiments G113-G115, wherein the second target-binding domain binds specifically to TGF-β.

Embodiment G120. The multi-specific chimeric polypeptide of embodiment G119, wherein the first target-binding domain is a soluble TGF-β receptor.

Embodiment G121. The multi-specific chimeric polypeptide of embodiment G120, wherein the soluble TGF-β receptor is a soluble TGFβRII receptor.

Embodiment G122. The multi-specific chimeric polypeptide of any one of embodiments G113-G118, wherein the second chimeric polypeptide further comprises an additional target-binding domain that binds specifically to TGF-β.

Embodiment G123. The multi-specific chimeric polypeptide of embodiment G122, wherein the first target-binding domain is a soluble TGF-β receptor.

Embodiment G124. The multi-specific chimeric polypeptide of embodiment G123, wherein the soluble TGF-β receptor is a soluble TGFβRII receptor.

Embodiment G125. The multi-chain chimeric polypeptide of any one of embodiments G1-G34, wherein the first target-binding domain and the second targeting-binding domain each independently bind specifically to a TGF-β or a receptor for CD137L.

Embodiment G126. The multi-chain chimeric polypeptide of embodiment G125, wherein the first target-binding domain binds specifically to TGF-β and the second target-binding domain binds specifically to a receptor for CD137L.

Embodiment G127. The multi-specific chimeric polypeptide of embodiment G126, wherein the first target-binding domain is a soluble TGF-β receptor.

Embodiment G128. The multi-specific chimeric polypeptide of embodiment G127, wherein the soluble TGF-β receptor is a soluble TGFβRII receptor.

Embodiment G129. The multi-chain chimeric polypeptide of embodiment G128, wherein the second target-binding domain comprises a soluble CD137L protein.

Embodiment G130. The multi-chain chimeric polypeptide of embodiment G129, wherein the soluble CD137L protein is a soluble human CD137L.

Embodiment G131. The multi-chain chimeric polypeptide of any one of embodiments G126-G130, wherein the second chimeric polypeptide further comprises an additional target-binding domain that binds specifically to TGF-β.

Embodiment G132. The multi-specific chimeric polypeptide of embodiment G131, wherein the additional target-binding domain is a soluble TGF-β receptor.

Embodiment G133. The multi-specific chimeric polypeptide of embodiment G132, wherein the soluble TGF-β receptor is a soluble TGFβRII receptor.

Embodiment G134. The multi-chain chimeric polypeptide of embodiment G1, wherein the first chimeric polypeptide comprises a sequence that is at least 80% identical to SEQ ID NO: 207.

Embodiment G135. The multi-chain chimeric polypeptide of embodiment G134, wherein the first chimeric polypeptide comprises a sequence that is at least 90% identical to SEQ ID NO: 207.

Embodiment G136. The multi-chain chimeric polypeptide of embodiment G135, wherein the first chimeric polypeptide comprises a sequence that is at least 95% identical to SEQ ID NO: 207.

Embodiment G137. The multi-chain chimeric polypeptide of embodiment G136, wherein the first chimeric polypeptide comprises SEQ ID NO: 207.

Embodiment G138. The multi-chain chimeric polypeptide of embodiment G137, wherein the first chimeric polypeptide comprises SEQ ID NO: 209.

Embodiment G139. The multi-chain chimeric polypeptide of any one of embodiments G1 and G134-G138, wherein the second chimeric polypeptide comprises a sequence that is at least 80% identical to SEQ ID NO: 232.

Embodiment G140. The multi-chain chimeric polypeptide of embodiment G139, wherein the second chimeric polypeptide comprises a sequence that is at least 90% identical to SEQ ID NO: 232.

Embodiment G141. The multi-chain chimeric polypeptide of embodiment G140, wherein the second chimeric polypeptide comprises a sequence that is at least 95% identical to SEQ ID NO: 232.

Embodiment G142. The multi-chain chimeric polypeptide of embodiment G141, wherein the second chimeric polypeptide comprises SEQ ID NO: 232.

Embodiment G143. The multi-chain chimeric polypeptide of embodiment G142, wherein the second chimeric polypeptide comprises SEQ ID NO: 234.

Embodiment G144. The multi-chain chimeric polypeptide of embodiment GI, wherein the first chimeric polypeptide comprises a sequence that is at least 80% identical to SEQ ID NO: 236.

Embodiment G145. The multi-chain chimeric polypeptide of embodiment G144, wherein the first chimeric polypeptide comprises a sequence that is at least 90% identical to SEQ ID NO: 236.

Embodiment G146. The multi-chain chimeric polypeptide of embodiment G145, wherein the first chimeric polypeptide comprises a sequence that is at least 95% identical to SEQ ID NO: 236.

Embodiment G147. The multi-chain chimeric polypeptide of embodiment G146, wherein the first chimeric polypeptide comprises SEQ ID NO: 236.

Embodiment G148. The multi-chain chimeric polypeptide of embodiment G147, wherein the first chimeric polypeptide comprises SEQ ID NO: 238.

Embodiment G149. The multi-chain chimeric polypeptide of any one of embodiments G1 and G144-G148, wherein the second chimeric polypeptide comprises a sequence that is at least 80% identical to SEQ ID NO: 232.

Embodiment G150. The multi-chain chimeric polypeptide of embodiment G149, wherein the second chimeric polypeptide comprises a sequence that is at least 90% identical to SEQ ID NO: 232.

Embodiment G151. The multi-chain chimeric polypeptide of embodiment G150, wherein the second chimeric polypeptide comprises a sequence that is at least 95% identical to SEQ ID NO: 232.

Embodiment G152. The multi-chain chimeric polypeptide of embodiment G151, wherein the second chimeric polypeptide comprises SEQ ID NO: 232.

Embodiment G153. The multi-chain chimeric polypeptide of embodiment G152, wherein the second chimeric polypeptide comprises SEQ ID NO: 234.

Embodiment G154. The multi-chain chimeric polypeptide of embodiment G1, wherein the first chimeric polypeptide comprises a sequence that is at least 80% identical to SEQ ID NO: 207.

Embodiment G155. The multi-chain chimeric polypeptide of embodiment G154, wherein the first chimeric polypeptide comprises a sequence that is at least 90% identical to SEQ ID NO: 207.

Embodiment G156. The multi-chain chimeric polypeptide of embodiment G155, wherein the first chimeric polypeptide comprises a sequence that is at least 95% identical to SEQ ID NO: 207.

Embodiment G157. The multi-chain chimeric polypeptide of embodiment G156, wherein the first chimeric polypeptide comprises SEQ ID NO: 207.

Embodiment G158. The multi-chain chimeric polypeptide of embodiment G157, wherein the first chimeric polypeptide comprises SEQ ID NO: 209.

Embodiment G159. The multi-chain chimeric polypeptide of any one of embodiments G1 and G154-G158, wherein the second chimeric polypeptide comprises a sequence that is at least 80% identical to SEQ ID NO: 203.

Embodiment G160. The multi-chain chimeric polypeptide of embodiment G159, wherein the second chimeric polypeptide comprises a sequence that is at least 90% identical to SEQ ID NO: 203.

Embodiment G161. The multi-chain chimeric polypeptide of embodiment G160, wherein the second chimeric polypeptide comprises a sequence that is at least 95% identical to SEQ ID NO: 203.

Embodiment G162. The multi-chain chimeric polypeptide of embodiment G161, wherein the second chimeric polypeptide comprises SEQ ID NO: 203.

Embodiment G163. The multi-chain chimeric polypeptide of embodiment G162, wherein the second chimeric polypeptide comprises SEQ ID NO: 250.

Embodiment G164. The multi-chain chimeric polypeptide of embodiment G1, wherein the first chimeric polypeptide comprises a sequence that is at least 80% identical to SEQ ID NO: 236.

Embodiment G165. The multi-chain chimeric polypeptide of embodiment G164, wherein the first chimeric polypeptide comprises a sequence that is at least 90% identical to SEQ ID NO: 236.

Embodiment G166. The multi-chain chimeric polypeptide of embodiment G165, wherein the first chimeric polypeptide comprises a sequence that is at least 95% identical to SEQ ID NO: 236.

Embodiment G167. The multi-chain chimeric polypeptide of embodiment G166, wherein the first chimeric polypeptide comprises SEQ ID NO: 236.

Embodiment G168. The multi-chain chimeric polypeptide of embodiment G167, wherein the first chimeric polypeptide comprises SEQ ID NO: 238.

Embodiment G169. The multi-chain chimeric polypeptide of any one of embodiments G1 and G164-G168, wherein the second chimeric polypeptide comprises a sequence that is at least 80% identical to SEQ ID NO: 193.

Embodiment G170. The multi-chain chimeric polypeptide of embodiment G169, wherein the second chimeric polypeptide comprises a sequence that is at least 90% identical to SEQ ID NO: 193.

Embodiment G171. The multi-chain chimeric polypeptide of embodiment G170, wherein the second chimeric polypeptide comprises a sequence that is at least 95% identical to SEQ ID NO: 193.

Embodiment G172. The multi-chain chimeric polypeptide of embodiment G171, wherein the second chimeric polypeptide comprises SEQ ID NO: 193.

Embodiment G173. The multi-chain chimeric polypeptide of embodiment G172, wherein the second chimeric polypeptide comprises SEQ ID NO: 195.

Embodiment G174. The multi-chain chimeric polypeptide of embodiment G1, wherein the first chimeric polypeptide comprises a sequence that is at least 80% identical to SEQ ID NO: 207.

Embodiment G175. The multi-chain chimeric polypeptide of embodiment G174, wherein the first chimeric polypeptide comprises a sequence that is at least 90% identical to SEQ ID NO: 207.

Embodiment G176. The multi-chain chimeric polypeptide of embodiment G175, wherein the first chimeric polypeptide comprises a sequence that is at least 95% identical to SEQ ID NO: 207.

Embodiment G177. The multi-chain chimeric polypeptide of embodiment G176, wherein the first chimeric polypeptide comprises SEQ ID NO: 207.

Embodiment G178. The multi-chain chimeric polypeptide of embodiment G177, wherein the first chimeric polypeptide comprises SEQ ID NO: 209.

Embodiment G179. The multi-chain chimeric polypeptide of any one of embodiments G1 and G174-G178, wherein the second chimeric polypeptide comprises a sequence that is at least 80% identical to SEQ ID NO: 268.

Embodiment G180. The multi-chain chimeric polypeptide of embodiment G179, wherein the second chimeric polypeptide comprises a sequence that is at least 90% identical to SEQ ID NO: 268.

Embodiment G181. The multi-chain chimeric polypeptide of embodiment G180, wherein the second chimeric polypeptide comprises a sequence that is at least 95% identical to SEQ ID NO: 268.

Embodiment G182. The multi-chain chimeric polypeptide of embodiment G181, wherein the second chimeric polypeptide comprises SEQ ID NO: 268.

Embodiment G183. The multi-chain chimeric polypeptide of embodiment G182, wherein the second chimeric polypeptide comprises SEQ ID NO: 270.

Embodiment G184. The multi-chain chimeric polypeptide of embodiment GI, wherein the first chimeric polypeptide comprises a sequence that is at least 80% identical to SEQ ID NO: 207.

Embodiment G185. The multi-chain chimeric polypeptide of embodiment G184, wherein the first chimeric polypeptide comprises a sequence that is at least 90% identical to SEQ ID NO: 207.

Embodiment G186. The multi-chain chimeric polypeptide of embodiment G185, wherein the first chimeric polypeptide comprises a sequence that is at least 95% identical to SEQ ID NO: 207.

Embodiment G187. The multi-chain chimeric polypeptide of embodiment G186, wherein the first chimeric polypeptide comprises SEQ ID NO: 207.

Embodiment G188. The multi-chain chimeric polypeptide of embodiment G187, wherein the first chimeric polypeptide comprises SEQ ID NO: 209.

Embodiment G189. The multi-chain chimeric polypeptide of any one of embodiments G1 and G184-G188, wherein the second chimeric polypeptide comprises a sequence that is at least 80% identical to SEQ ID NO: 272.

Embodiment G190. The multi-chain chimeric polypeptide of embodiment G189, wherein the second chimeric polypeptide comprises a sequence that is at least 90% identical to SEQ ID NO: 272.

Embodiment G191. The multi-chain chimeric polypeptide of embodiment G190, wherein the second chimeric polypeptide comprises a sequence that is at least 95% identical to SEQ ID NO: 272.

Embodiment G192. The multi-chain chimeric polypeptide of embodiment G191, wherein the second chimeric polypeptide comprises SEQ ID NO: 272.

Embodiment G193. The multi-chain chimeric polypeptide of embodiment G192, wherein the second chimeric polypeptide comprises SEQ ID NO: 272.

Embodiment G194. The multi-chain chimeric polypeptide of embodiment G1, wherein the first chimeric polypeptide comprises a sequence that is at least 80% identical to SEQ ID NO: 207.

Embodiment G195. The multi-chain chimeric polypeptide of embodiment G194, wherein the first chimeric polypeptide comprises a sequence that is at least 90% identical to SEQ ID NO: 207.

Embodiment G196. The multi-chain chimeric polypeptide of embodiment G195, wherein the first chimeric polypeptide comprises a sequence that is at least 95% identical to SEQ ID NO: 207.

Embodiment G197. The multi-chain chimeric polypeptide of embodiment G196, wherein the first chimeric polypeptide comprises SEQ ID NO: 207.

Embodiment G198. The multi-chain chimeric polypeptide of embodiment G197, wherein the first chimeric polypeptide comprises SEQ ID NO: 209.

Embodiment G199. The multi-chain chimeric polypeptide of any one of embodiments G1 and G194-G198, wherein the second chimeric polypeptide comprises a sequence that is at least 80% identical to SEQ ID NO: 193.

Embodiment G200. The multi-chain chimeric polypeptide of embodiment G199, wherein the second chimeric polypeptide comprises a sequence that is at least 90% identical to SEQ ID NO: 193.

Embodiment G201. The multi-chain chimeric polypeptide of embodiment G200, wherein the second chimeric polypeptide comprises a sequence that is at least 95% identical to SEQ ID NO: 193.

Embodiment G202. The multi-chain chimeric polypeptide of embodiment G201, wherein the second chimeric polypeptide comprises SEQ ID NO: 193.

Embodiment G203. The multi-chain chimeric polypeptide of embodiment G202, wherein the second chimeric polypeptide comprises SEQ ID NO: 195.

Embodiment G204. The multi-chain chimeric polypeptide of embodiment G1, wherein the first chimeric polypeptide comprises a sequence that is at least 80% identical to SEQ ID NO: 236.

Embodiment G205. The multi-chain chimeric polypeptide of embodiment G204, wherein the first chimeric polypeptide comprises a sequence that is at least 90% identical to SEQ ID NO: 236.

Embodiment G206. The multi-chain chimeric polypeptide of embodiment G205, wherein the first chimeric polypeptide comprises a sequence that is at least 95% identical to SEQ ID NO: 236.

Embodiment G207. The multi-chain chimeric polypeptide of embodiment G206, wherein the first chimeric polypeptide comprises SEQ ID NO: 236.

Embodiment G208. The multi-chain chimeric polypeptide of embodiment G207, wherein the first chimeric polypeptide comprises SEQ ID NO: 238.

Embodiment G209. The multi-chain chimeric polypeptide of any one of embodiments G1 and G204-G208, wherein the second chimeric polypeptide comprises a sequence that is at least 80% identical to SEQ ID NO: 268.

Embodiment G210. The multi-chain chimeric polypeptide of embodiment G209, wherein the second chimeric polypeptide comprises a sequence that is at least 90% identical to SEQ ID NO: 268.

Embodiment G211. The multi-chain chimeric polypeptide of embodiment G210, wherein the second chimeric polypeptide comprises a sequence that is at least 95% identical to SEQ ID NO: 268.

Embodiment G212. The multi-chain chimeric polypeptide of embodiment G211, wherein the second chimeric polypeptide comprises SEQ ID NO: 268.

Embodiment G213. The multi-chain chimeric polypeptide of embodiment G212, wherein the second chimeric polypeptide comprises SEQ ID NO: 270.

Embodiment G214. The multi-chain chimeric polypeptide of embodiment GI, wherein the first chimeric polypeptide comprises a sequence that is at least 80% identical to SEQ ID NO: 236.

Embodiment G215. The multi-chain chimeric polypeptide of embodiment G214, wherein the first chimeric polypeptide comprises a sequence that is at least 90% identical to SEQ ID NO: 236.

Embodiment G216. The multi-chain chimeric polypeptide of embodiment G215, wherein the first chimeric polypeptide comprises a sequence that is at least 95% identical to SEQ ID NO: 236.

Embodiment G217. The multi-chain chimeric polypeptide of embodiment G216, wherein the first chimeric polypeptide comprises SEQ ID NO: 236.

Embodiment G218. The multi-chain chimeric polypeptide of embodiment G217, wherein the first chimeric polypeptide comprises SEQ ID NO: 238.

Embodiment G219. The multi-chain chimeric polypeptide of any one of embodiments G1 and G214-G218, wherein the second chimeric polypeptide comprises a sequence that is at least 80% identical to SEQ ID NO: 300.

Embodiment G220. The multi-chain chimeric polypeptide of embodiment G219, wherein the second chimeric polypeptide comprises a sequence that is at least 90% identical to SEQ ID NO: 300.

Embodiment G221. The multi-chain chimeric polypeptide of embodiment G220, wherein the second chimeric polypeptide comprises a sequence that is at least 95% identical to SEQ ID NO: 300.

Embodiment G222. The multi-chain chimeric polypeptide of embodiment G221, wherein the second chimeric polypeptide comprises SEQ ID NO: 300.

Embodiment G223. The multi-chain chimeric polypeptide of embodiment G222, wherein the second chimeric polypeptide comprises SEQ ID NO: 302.

Embodiment G224. The multi-chain chimeric polypeptide of embodiment GI, wherein the first chimeric polypeptide comprises a sequence that is at least 80% identical to SEQ ID NO: 236.

Embodiment G225. The multi-chain chimeric polypeptide of embodiment G224, wherein the first chimeric polypeptide comprises a sequence that is at least 90% identical to SEQ ID NO: 236.

Embodiment G226. The multi-chain chimeric polypeptide of embodiment G225, wherein the first chimeric polypeptide comprises a sequence that is at least 95% identical to SEQ ID NO: 236.

Embodiment G227. The multi-chain chimeric polypeptide of embodiment G226, wherein the first chimeric polypeptide comprises SEQ ID NO: 236.

Embodiment G228. The multi-chain chimeric polypeptide of embodiment G227, wherein the first chimeric polypeptide comprises SEQ ID NO: 238.

Embodiment G229. The multi-chain chimeric polypeptide of any one of embodiments G1 and G224-G228, wherein the second chimeric polypeptide comprises a sequence that is at least 80% identical to SEQ ID NO: 308.

Embodiment G230. The multi-chain chimeric polypeptide of embodiment G229, wherein the second chimeric polypeptide comprises a sequence that is at least 90% identical to SEQ ID NO: 308.

Embodiment G231. The multi-chain chimeric polypeptide of embodiment G230, wherein the second chimeric polypeptide comprises a sequence that is at least 95% identical to SEQ ID NO: 308.

Embodiment G232. The multi-chain chimeric polypeptide of embodiment G231, wherein the second chimeric polypeptide comprises SEQ ID NO: 308.

Embodiment G233. The multi-chain chimeric polypeptide of embodiment G232, wherein the second chimeric polypeptide comprises SEQ ID NO: 310.

Embodiment G234. The multi-chain chimeric polypeptide of embodiment G1, wherein the first chimeric polypeptide comprises a sequence that is at least 80% identical to SEQ ID NO: 236.

Embodiment G235. The multi-chain chimeric polypeptide of embodiment G234, wherein the first chimeric polypeptide comprises a sequence that is at least 90% identical to SEQ ID NO: 236.

Embodiment G236. The multi-chain chimeric polypeptide of embodiment G235, wherein the first chimeric polypeptide comprises a sequence that is at least 95% identical to SEQ ID NO: 236.

Embodiment G237. The multi-chain chimeric polypeptide of embodiment G236, wherein the first chimeric polypeptide comprises SEQ ID NO: 236.

Embodiment G238. The multi-chain chimeric polypeptide of embodiment G237, wherein the first chimeric polypeptide comprises SEQ ID NO: 238.

Embodiment G239. The multi-chain chimeric polypeptide of any one of embodiments GI and G234-G238, wherein the second chimeric polypeptide comprises a sequence that is at least 80% identical to SEQ ID NO: 316.

Embodiment G240. The multi-chain chimeric polypeptide of embodiment G239, wherein the second chimeric polypeptide comprises a sequence that is at least 90% identical to SEQ ID NO: 316.

Embodiment G241. The multi-chain chimeric polypeptide of embodiment G240, wherein the second chimeric polypeptide comprises a sequence that is at least 95% identical to SEQ ID NO: 316.

Embodiment G242. The multi-chain chimeric polypeptide of embodiment G241, wherein the second chimeric polypeptide comprises SEQ ID NO: 316.

Embodiment G243. The multi-chain chimeric polypeptide of embodiment G242, wherein the second chimeric polypeptide comprises SEQ ID NO: 318.

Embodiment G244. The multi-chain chimeric polypeptide of any one of embodiments G1-G133, wherein the first chimeric polypeptide further comprises one or more additional target-binding domain(s), where at least one of the one or more additional antigen-binding domain(s) is positioned between the soluble tissue factor domain and the first domain of the pair of affinity domains.

Embodiment G245. The multi-chain chimeric polypeptide of embodiment G244, wherein the first chimeric polypeptide further comprises a linker sequence between the soluble tissue factor domain and the at least one of the one or more additional antigen-binding domain(s), and/or a linker sequence between the at least one of the one or more additional antigen-binding domain(s) and the first domain of the pair of affinity domains.

Embodiment G246. The multi-chain chimeric polypeptide of any one of embodiments GI-G133, wherein the first chimeric polypeptide further comprises one or more additional target-binding domains at the N-terminal and/or C-terminal end of the first chimeric polypeptide.

Embodiment G247. The multi-chain chimeric polypeptide of embodiment G246, wherein at least one of the one or more additional target-binding domains directly abuts the first domain of the pair of affinity domains in the first chimeric polypeptide.

Embodiment G248. The multi-chain chimeric polypeptide of embodiment G246, wherein the first chimeric polypeptide further comprises a linker sequence between the at least one of the one or more additional target-binding domains and the first domain of the pair of affinity domains.

Embodiment G249. The multi-chain chimeric polypeptide of embodiment G246, wherein the at least one of the one or more additional target-binding domains directly abuts the first target-binding domain in the first chimeric polypeptide.

Embodiment G250. The multi-chain chimeric polypeptide of embodiment G246, wherein the first chimeric polypeptide further comprises a linker sequence between the at least one of the one or more additional target-binding domains and the first target-binding domain.

Embodiment G251. The multi-chain chimeric polypeptide of embodiment G246, wherein at least one of the one or more additional target-binding domains is disposed at the N- and/or C-terminus of the first chimeric polypeptide, and at least one of the one or more additional target-binding domains is positioned between the soluble tissue factor domain and the first domain of the pair of affinity domains in the first chimeric polypeptide.

Embodiment G252. The multi-chain chimeric polypeptide of embodiment G251, wherein the at least one additional target-binding domain of the one or more additional target-binding domains disposed at the N-terminus directly abuts the first target-binding domain or the first domain of the pair of affinity domains in the first chimeric polypeptide.

Embodiment G253. The multi-chain chimeric polypeptide of embodiment G251, wherein the first chimeric polypeptide further comprises a linker sequence disposed between the at least one additional target-binding domain and the first target-binding domain or the first domain of the pair of affinity domains in the first chimeric polypeptide.

Embodiment G254. The multi-chain chimeric polypeptide of embodiment G251, wherein the at least one additional target-binding domain of the one or more additional target-binding domains disposed at the C-terminus directly abuts the first target-binding domain or the first domain of the pair of affinity domains in the first chimeric polypeptide.

Embodiment G255. The multi-chain chimeric polypeptide of embodiment G251, wherein the first chimeric polypeptide further comprises a linker sequence disposed between the at least one additional target-binding domain and the first target-binding domain or the first domain of the pair of affinity domains in the first chimeric polypeptide.

Embodiment G256. The multi-chain chimeric polypeptide of embodiment G251, wherein the at least one of the one or more additional target-binding domains positioned between the soluble tissue factor domain and the first domain of the pair of affinity domains, directly abuts the soluble tissue factor domain and/or the first domain of the pair of affinity domains.

Embodiment G257. The multi-chain chimeric polypeptide of embodiment G251, wherein the first chimeric polypeptide further comprises a linker sequence disposed (i) between the soluble tissue factor domain and the at least one of the one or more additional target-binding domains positioned between the soluble tissue factor domain and the first domain of the pair of affinity domains, and/or (ii) between the first domain of the pair of affinity domains and the at least one of the one or more additional target-binding domains positioned between the soluble tissue factor domain and the first domain of the pair of affinity domains.

Embodiment G258. The multi-chain chimeric polypeptide of any one of embodiments G44-G46, G57-G59, G76-G78, G96-G98, G109-G111, G122-G124, and G131-G133, wherein the second chimeric polypeptide further comprises the additional target-binding domain at the N-terminal end or the C-terminal end of the second chimeric polypeptide.

Embodiment G259. The multi-chain chimeric polypeptide of embodiment G258, wherein the additional target-binding domain directly abuts the second domain of the pair of affinity domains in the second chimeric polypeptide.

Embodiment G260. The multi-chain chimeric polypeptide of embodiment G258, wherein the second chimeric polypeptide further comprises a linker sequence between the additional target-binding domain and the second domain of the pair of affinity domains in the second chimeric polypeptide.

Embodiment G261. The multi-chain chimeric polypeptide of embodiment G258, wherein the additional target-binding domain directly abuts the second target-binding domain in the second chimeric polypeptide.

Embodiment G262. The multi-chain chimeric polypeptide of embodiment G258, wherein the second chimeric polypeptide further comprises a linker sequence between the additional target-binding domain and the second target-binding domain in the second chimeric polypeptide.

Embodiment G263. A composition comprising any of the multi-chain chimeric polypeptides of embodiments G1-G262.

Embodiment G264. The composition of embodiment G263, wherein the composition is a pharmaceutical composition.

Embodiment G265. A kit comprising at least one dose of the composition of embodiment G263 or G264.

Embodiment G266. Nucleic acid encoding any of the multi-chain chimeric polypeptides of any one of embodiments G1-G262.

Embodiment G267. A vector comprising the nucleic acid of embodiment G266.

Embodiment G268. The vector of embodiment G267, wherein the vector is an expression vector.

Embodiment G269. A cell comprising the nucleic acid of embodiment G323 or the vector of embodiment G267 or G268.

Embodiment G270. A method of producing a multi-chain chimeric polypeptide, the method comprising:
culturing the cell of embodiment G269 in a culture medium under conditions sufficient to result in the production of the multi-chain chimeric polypeptide; and
recovering the multi-chain chimeric polypeptide from the cell and/or the culture medium.

Embodiment G271. A multi-chain chimeric polypeptide produced by the method of embodiment G270.

Embodiment G272. The multi-chain chimeric polypeptide of embodiment G8, wherein the soluble human tissue factor domain comprises a sequence that is at least 80% identical to SEQ ID NO: 97.

Embodiment G273. The multi-chain chimeric polypeptide of embodiment G272, wherein the soluble human tissue factor domain comprises a sequence that is at least 90% identical to SEQ ID NO: 97.

Embodiment G274. The multi-chain chimeric polypeptide of embodiment G273, wherein the soluble human tissue factor domain comprises a sequence that is at least 95% identical to SEQ ID NO: 97.

Embodiment G275. The multi-chain chimeric polypeptide of embodiment G274, wherein the soluble human tissue factor domain comprises a sequence that is 100% identical to SEQ ID NO: 97.

Embodiment G276. The multi-chain chimeric polypeptide of embodiment G8, wherein the soluble human tissue factor domain comprises a sequence that is at least 80% identical to SEQ ID NO: 98.

Embodiment G277. The multi-chain chimeric polypeptide of embodiment G276, wherein the soluble human tissue factor domain comprises a sequence that is at least 90% identical to SEQ ID NO: 98.

Embodiment G278. The multi-chain chimeric polypeptide of embodiment G277, wherein the soluble human tissue factor domain comprises a sequence that is at least 95% identical to SEQ ID NO: 98.

Embodiment G279. The multi-chain chimeric polypeptide of embodiment G278, wherein the soluble human tissue factor domain comprises a sequence that is 100% identical to SEQ ID NO: 98.

Embodiment H1. A method of treating an aging-related disease or condition in a subject in need thereof, the method comprising administering to a subject identified as having an aging-related disease or condition a therapeutically effective amount of one or more natural killer (NK) cell activating agent(s).

Embodiment H2. A method of killing or reducing the number of senescent cells in a subject in need thereof, the method comprising administering to the subject a therapeutically effective amount of one or more NK cell activating agent(s).

Embodiment H3. The method of embodiment H2, wherein the senescent cells are senescent cancer cells, senescent monocytes, senescent lymphocytes, senescent astrocytes, senescent microglia, senescent neurons, senescent tissue fibroblasts, senescent dermal fibroblasts, senescent keratinocytes, or other differentiated tissue-specific dividing functional cells.

Embodiment H4. The method of embodiment H3, wherein the senescent cancer cells are chemotherapy-induced senescent cells or radiation-induced senescent cells.

Embodiment 115. The method of embodiment H1-H2, wherein the subject has been identified or diagnosed as having an aging-related disease or condition.

Embodiment H6. The method of embodiment H1 or H5, wherein the aging-related disease or condition is selected from the group consisting of: a cancer, an autoimmune disease, a metabolic disease, a neurodegenerative disease, a cardiovascular disease, a skin disease, a progeria disease, and a fragility disease.

Embodiment H7. The method of embodiment H6, wherein the cancer is selected from the group consisting of: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, B-cell lymphoma, B-cell non-Hodgkin's lymphoma, Hodgkin's lymphoma, chronic lymphocytic leukemia (CLL), acute myeloid leukemia (AML), chronic myeloid leukemia (CML), acute lymphocytic leukemia (ALL), myelodysplastic syndromes (MDS), cutaneous T-cell lymphoma, retinoblastoma, stomach cancer, urothelial carcinoma, lung cancer, renal cell carcinoma, gastric and esophageal cancer, pancreatic cancer, prostate cancer, breast cancer, colorectal cancer, ovarian cancer, non-small cell lung carcinoma, squamous cell head and neck carcinoma, endometrial cancer, cervical cancer, liver cancer, and hepatocellular carcinoma.

Embodiment H8. The method of embodiment H6, wherein the autoimmune disease is type-1 diabetes.

Embodiment H9. The method of embodiment H6, wherein the metabolic disease is selected from the group consisting of: obesity, a lipodystrophy, and type 2 diabetes mellitus.

Embodiment H10. The method of embodiment H6, wherein the neurodegenerative disease is selected from the group consisting of: Alzheimer's disease, Parkinson's disease, and dementia.

Embodiment H11. The method of embodiment H6, wherein the cardiovascular disease is selected from the group consisting of: coronary artery disease, atherosclerosis, and pulmonary arterial hypertension.

Embodiment H12. The method of embodiment H6, wherein the skin disease is selected from the group consisting of: wound healing, alopecia, wrinkles, senile lentigo, skin thinning, xeroderma pigmentosum, and dyskeratosis congenita.

Embodiment H13. The method of embodiment H6, wherein the progeria disease is selected from the group consisting of: progeria and Hutchinson-Gilford Progeria Syndrome.

Embodiment H14. The method of embodiment H6, wherein the fragility disease is selected from the group consisting of: frailty, responsiveness to vaccination, osteoporosis, and sarcopenia.

Embodiment H15. The method of embodiment H1 or H5, wherein the aging-related disease or condition is selected from the group of: age-related macular degeneration osteoarthritis, adipose atrophy, chronic obstructive pulmonary disease, idiopathic pulmonary fibrosis, kidney transplant failure, liver fibrosis, loss of bone mass, sarcopenia, age-associated loss of lung tissue elasticity, osteoporosis, age-associated renal dysfunction, and chemical-induced renal dysfunction.

Embodiment H16. The method of embodiment H1 or H5, wherein the aging-related disease or condition is type 2 diabetes or atherosclerosis.

Embodiment H17. The method of any one of embodiments H1-H16, wherein the administering results in a decrease in the number of senescent cells in a target tissue in the subject.

Embodiment H18. The method of embodiment H17, wherein the target tissue is selected from the group consisting of: adipose tissue, pancreatic tissue, liver tissue, lung tissue, vasculature, bone tissue, central nervous system (CNS) tissue, eye tissue, skin tissue, muscle tissue, and secondary lympho-organ tissue.

Embodiment H19. The method of any one of embodiments H1-H18, wherein the administering results in an increase in the expression levels of CD25, CD69, MTOR-C1, SREBP1, IFN-γ, and granzyme B in activated NK cells.

Embodiment H20. A method of treating an aging-related disease or condition in a subject in need thereof, the method comprising administering to a subject identified as having an aging-related disease or condition a therapeutically effective number of activated NK cells.

Embodiment H21. A method of killing or reducing the number of senescent cells in a subject in need thereof, the method comprising administering to the subject a therapeutically effective number of activated NK cells.

Embodiment H22. The method of embodiment H21, wherein the senescent cells are senescent cancer cells, senescent monocytes, senescent lymphocytes, senescent astrocytes, senescent microglia, senescent neurons, senescent tissue fibroblasts, senescent dermal fibroblasts, senescent keratinocytes, or other differentiated tissue-specific dividing functional cells.

Embodiment H23. The method of embodiment H22, wherein the senescent cancer cells are chemotherapy-induced senescent cells or radiation-induced senescent cells.

Embodiment H24. The method of embodiment H21, wherein the subject has been identified or diagnosed as having an aging-related disease or condition.

Embodiment H25. The method of embodiment H20 or H24, wherein the aging-related disease or condition is selected from the group consisting of: a cancer, an autoimmune disease, a metabolic disease, a neurodegenerative disease, a cardiovascular disease, a skin disease, a progeria disease, and a fragility disease.

Embodiment H26. The method of embodiment H25, wherein the cancer is selected from the group consisting of: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, B-cell lymphoma, B-cell non-Hodgkin's lymphoma, Hodgkin's lymphoma, chronic lymphocytic leukemia (CLL), acute myeloid leukemia (AML), chronic myeloid leukemia (CML), acute lymphocytic leukemia (ALL), myelodysplastic syndromes (MDS), cutaneous T-cell lymphoma, retinoblastoma, stomach cancer, urothelial carcinoma, lung cancer, renal cell carcinoma, gastric and esophageal cancer, pancreatic cancer, prostate cancer, breast cancer, colorectal cancer, ovarian cancer, non-small cell lung carcinoma, squamous cell head and neck carcinoma, endometrial cancer, cervical cancer, liver cancer, and hepatocellular carcinoma.

Embodiment H27. The method of embodiment H25, wherein the autoimmune disease is type-1 diabetes.

Embodiment H28. The method of embodiment H25, wherein the metabolic disease is selected from the group consisting of: obesity, a lipodystrophy, and type 2 diabetes mellitus.

Embodiment H29. The method of embodiment H25, wherein the neurodegenerative disease is selected from the group consisting of: Alzheimer's disease, Parkinson's disease, and dementia.

Embodiment H30. The method of embodiment H25, wherein the cardiovascular disease is selected from the group consisting of: coronary artery disease, atherosclerosis, and pulmonary arterial hypertension.

Embodiment H31. The method of embodiment H25, wherein the skin disease is selected from the group consisting of: wound healing, alopecia, wrinkles, senile lentigo, skin thinning, xeroderma pigmentosum, and dyskeratosis congenita.

Embodiment H32. The method of embodiment H25, wherein the progeria disease is selected from the group consisting of: progeria and Hutchinson-Gilford Progeria Syndrome.

Embodiment H33. The method of embodiment H25, wherein the fragility disease is selected from the group consisting of: frailty, responsiveness to vaccination, osteoporosis, and sarcopenia.

Embodiment H34. The method of embodiment H20 or H24, wherein the aging-related disease or condition is selected from the group consisting of: age-related macular degeneration, osteoarthritis, adipose atrophy, chronic obstructive pulmonary disease, idiopathic pulmonary fibrosis, kidney transplant failure, liver fibrosis, loss of bone mass, sarcopenia, age-associated loss of lung tissue elasticity, osteoporosis, age-associated renal dysfunction, and chemical-induced renal dysfunction.

Embodiment H35. The method of any one of embodiments H20-H34, wherein the method further comprises:
obtaining a resting NK cell; and
contacting the resting NK cell in vitro in a liquid culture medium comprising one or more NK cell activating agent(s), wherein the contacting results in the generation of the activated NK cells that are subsequently administered to the subject.

Embodiment H36. The method of embodiment H35, wherein the resting NK cell is an autologous NK cell obtained from the subject.

Embodiment H37. The method of embodiment H35, wherein the resting NK cell is an allogeneic resting NK cell.

Embodiment H38. The method of embodiment H35, wherein the resting NK cell is an artificial NK cell.

Embodiment H39. The method of embodiment H35, wherein the resting NK cell is a haploidentical resting NK cell.

Embodiment H40. The method of any one of embodiments H35-H39, wherein the resting NK cell is a genetically-engineered NK cell carrying a chimeric antigen receptor or recombinant T cell receptor.

Embodiment H41. The method of any one of embodiments H35-H40, wherein the method further comprises isolating the activated NK cells before the activated NK cells are administered to the subject.

Embodiment H42. A method of improving the texture and/or appearance of skin and/or hair in a subject in need thereof over a period of time, the method comprising administering to the subject a therapeutically effective amount of one or more natural killer (NK) cell activating agent(s).

Embodiment H43. A method of improving the texture and/or appearance of skin and/or hair in a subject in need thereof over a period of time, the method comprising administering to the subject a therapeutically effective number of activated NK cells.

Embodiment H44. The method of embodiment H43, wherein the method further comprises:
obtaining a resting NK cell; and
contacting the resting NK cell in vitro in a liquid culture medium comprising one or more NK cell activating agent(s), wherein the contacting results in the generation of the activated NK cells that are subsequently administered to the subject.

Embodiment H45. The method of embodiment H44, wherein the resting NK cell is an autologous NK cell obtained from the subject.

Embodiment H46. The method of embodiment H44, wherein the resting NK cell is an allogeneic resting NK cell.

Embodiment H47. The method of embodiment H44, wherein the resting NK cell is an artificial NK cell.

Embodiment H48. The method of embodiment H44, wherein the resting NK cell is a haploidentical resting NK cell.

Embodiment H49. The method of any one of embodiments H44-H48, wherein the resting NK cell is a genetically-engineered NK cell carrying a chimeric antigen receptor or recombinant T cell receptor.

Embodiment H50. The method of any one of embodiments H44-H49, wherein the method further comprises isolating the activated NK cells before the activated NK cells are administered to the subject.

Embodiment H51. The method of any one of embodiments H42-H50, wherein the method provides for an improvement in the texture and/or appearance of skin of the subject over the period of time.

Embodiment H52. The method of embodiment H51, wherein the method results in a decrease in the rate of formation of wrinkles in the skin of the subject over the period of time.

Embodiment H53. The method of embodiment H51 or H52, wherein the method results in an improvement in the coloration of skin of the subject over the period of time.

Embodiment H54. The method of any one of embodiments H51-H53, wherein the method results in an improvement in the texture of skin of the subject over the period of time.

Embodiment H55. The method of any one of embodiments H42-H50, wherein the method provides for an improvement in the texture and/or appearance of hair of the subject over the period of time.

Embodiment H56. The method of embodiment H55, wherein the method results in a decrease in the rate of formation of gray hair in the subject over the period of time.

Embodiment H57. The method of embodiment H55 or H56, wherein the method results in a decrease in the number of gray hairs of the subject over the period of time.

Embodiment H58. The method of any one of embodiments H55-H57, wherein the method results in a decrease in the rate of hair loss in the subject over time.

Embodiment H59. The method of any one of embodiments H55-H58, wherein the method results in an improvement in the texture of hair of the subject over the period of time.

Embodiment H60. The method of any one of embodiments H42-H59, wherein the period of time is between about one month and about 10 years.

Embodiment H61. The method of any one of embodiments H42-H60, wherein the method results in a decrease in the number of senescent dermal fibroblasts in the skin of the subject over the period of time.

Embodiment H62. A method of assisting in the treatment of obesity in a subject in need thereof over a period of time, the method comprising administering to the subject a therapeutically effective amount of one or more natural killer (NK) cell activating agent(s).

Embodiment H63. A method of assisting in the treatment of obesity in a subject in need thereof over a period of time, the method comprising administering to the subject a therapeutically effective number of activated NK cells.

Embodiment H64. The method of embodiment H63, wherein the method further comprises:
obtaining a resting NK cell; and
contacting the resting NK cell in vitro in a liquid culture medium comprising one or more NK cell activating agent(s), wherein the contacting results in the generation of the activated NK cells that are subsequently administered to the subject.

Embodiment H65. The method of embodiment H64, wherein the resting NK cell is an autologous NK cell obtained from the subject.

Embodiment H66. The method of embodiment H64, wherein the resting NK cell is an allogeneic resting NK cell.

Embodiment H67. The method of embodiment H64, wherein the resting NK cell is an artificial NK cell.

Embodiment H68. The method of embodiment H64, wherein the resting NK cell is a haploidentical resting NK cell.

Embodiment H69. The method of any one of embodiments H64-H68, wherein the resting NK cell is a genetically-engineered NK cell carrying a chimeric antigen receptor or recombinant T cell receptor.

Embodiment H70. The method of any one of embodiments H64-H69, wherein the method further comprises isolating the activated NK cells before the activated NK cells are administered to the subject.

Embodiment H71. The method of any one of embodiments H62-H70, wherein the method results in a decrease in the mass of the subject over the period of time.

Embodiment H72. The method of any one of embodiments H62-H71, wherein the method results in a decrease in the body mass index (BMI) of the subject over the period of time.

Embodiment H73. The method of any one of embodiments H62-H70, wherein the method results in a decrease in the rate of progression from pre-diabetes to type 2 diabetes in the subject.

Embodiment H74. The method of any one of embodiments H62-H70, wherein the method results in a decrease in fasting serum glucose level in the subject.

Embodiment H75. The method of any one of embodiments H62-H70, wherein the method results in an increase in insulin sensitivity in the subject.

Embodiment H76. The method of any one of embodiments H62-H70, wherein the method results in a decrease in the severity of atherosclerosis in the subject.

Embodiment H77. The method of any one of embodiments H62-H76, wherein the period of time is between about two weeks and about 10 years.

Embodiment 1178. The method of any one of embodiments H1-H19, H35-H42, H44-H62, and H64-H77, wherein at least one of the one or more NK cell activating agent(s) results in activation of one or more of: a receptor for IL-2, a receptor for IL-7, a receptor for IL-12, a receptor for IL-15, a receptor for IL-18, a receptor for IL-21, a receptor for IL-33, CD16, CD69, CD25, CD36, CD59, CD352, NKp80, DNAM-1, 2B4, NKp30, NKp44, NKp46, NKG2D, KIR2DS1, KIR2Ds2/3, KIR2DL4, KIR2DS4, KIR2DS5, and KIR3DS1.

Embodiment H79. The method of embodiment H78, wherein the at least one of the one or more NK cell activating agent(s) that results in activation of a receptor for IL-2 is a soluble IL-2 or an agonistic antibody that binds specifically to an IL-2 receptor.

Embodiment H80. The method of embodiment H78, wherein the at least one of the one or more NK cell activating agent(s) that results in activation of a receptor for IL-7 is a soluble IL-7 or an agonistic antibody that binds specifically to an IL-7 receptor.

Embodiment H81. The method of embodiment H78, wherein the at least one of the one or more NK cell activating agent(s) that results in activation of a receptor for IL-12 is a soluble IL-12 or an agonistic antibody that binds specifically to an IL-12 receptor.

Embodiment H82. The method of embodiment H78, wherein the at least one of the one or more NK cell activating agent(s) that results in activation of a receptor for IL-15 is a soluble IL-15 or an agonistic antibody that binds specifically to an IL-15 receptor.

Embodiment H83. The method of embodiment H78, wherein the at least one of the one or more NK cell activating agent(s) that results in activation of a receptor for IL-21 is a soluble IL-21 or an agonistic antibody that binds specifically to an IL-21 receptor.

Embodiment H84. The method of embodiment H78, wherein the at least one of the one or more NK cell activating agent(s) that results in activation of a receptor for IL-33 is a soluble IL-33 or an agonistic antibody that binds specifically to an IL-33 receptor.

Embodiment H85. The method of embodiment H78, wherein the at least one of the one or more NK cell activating agent(s) that results in activation of a receptor for CD16 is an agonistic antibody that binds specifically to a CD16.

Embodiment H86. The method of embodiment H78, wherein the at least one of the one or more NK cell activating agent(s) that results in activation of a receptor for CD69 is an agonistic antibody that binds specifically to a CD69.

Embodiment H87. The method of embodiment H78, wherein the at least one of the one or more NK cell activating agent(s) that results in activation of a receptor for CD25, CD36, CD59 is an agonistic antibody that binds specifically to a CD25, CD6, CD59.

Embodiment H88. The method of embodiment H78, wherein the at least one of the one or more NK cell activating agent(s) that results in activation of a receptor for CD352 is an agonistic antibody that binds specifically to a CD352.

Embodiment H89. The method of embodiment H78, wherein the at least one of the one or more NK cell activating agent(s) that results in activation of a receptor for NKp80 is an agonistic antibody that binds specifically to an NKp80.

Embodiment H90. The method of embodiment H78, wherein the at least one of the one or more NK cell activating agent(s) that results in activation of a receptor for DNAM-1 is an agonistic antibody that binds specifically to a DNAM-1.

Embodiment H91. The method of embodiment H78, wherein the at least one of the one or more NK cell activating agent(s) that results in activation of a receptor for 2B4 is an agonistic antibody that binds specifically to a 2B4.

Embodiment H92. The method of embodiment H78, wherein the at least one of the one or more NK cell activating agent(s) that results in activation of a receptor for NKp30 is an agonistic antibody that binds specifically to an NKp30.

Embodiment H93. The method of embodiment H78, wherein the at least one of the one or more NK cell activating agent(s) that results in activation of a receptor for NKp44 is an agonistic antibody that binds specifically to an NKp44.

Embodiment H94. The method of embodiment H78, wherein the at least one of the one or more NK cell activating agent(s) that results in activation of a receptor for NKp46 is an agonistic antibody that binds specifically to an NKp46.

Embodiment H95. The method of embodiment H78, wherein the at least one of the one or more NK cell activating agent(s) that results in activation of a receptor for NKG2D is an agonistic antibody that binds specifically to an NKG2D.

Embodiment H96. The method of embodiment H78, wherein the at least one of the one or more NK cell activating agent(s) that results in activation of a receptor for KIR2DS1 is an agonistic antibody that binds specifically to a KIR2DS1.

Embodiment H97. The method of embodiment H78, wherein the at least one of the one or more NK cell activating agent(s) that results in activation of a receptor for KIR2DS2/3 is an agonistic antibody that binds specifically to a KIR2DS2/3.

Embodiment H98. The method of embodiment H78, wherein the at least one of the one or more NK cell activating agent(s) that results in activation of a receptor for KIR2DL4 is an agonistic antibody that binds specifically to a KIR2DL4.

Embodiment H99. The method of embodiment H78, wherein the at least one of the one or more NK cell activating agent(s) that results in activation of a receptor for KIR2DS4 is an agonistic antibody that binds specifically to a KIR2DS4.

Embodiment H100. The method of embodiment H78, wherein the at least one of the one or more NK cell activating agent(s) that results in activation of a receptor for KIR2DS5 is an agonistic antibody that binds specifically to a KIR2DS5.

Embodiment H101. The method of embodiment H78, wherein the at least one of the one or more NK cell activating agent(s) that results in activation of a receptor for KIR3DS1 is an agonistic antibody that binds specifically to a KIR3DS1.

Embodiment H102. The method of any one of embodiments H1-H19, H35-H42, H44-H62, and H64-H101, wherein at least one of the one or more NK cell activating agent(s) results in a decrease in the activation of one or more of: PD-1, a TGF-β receptor, TIGIT, CD1, TIM-3, Siglec-7, IRP60, Tactile, IL1R8, NKG2A/KLRD1, KIR2DL1, KIR2DL2/3, KIR2DL5, KIR3DL1, KIR3DL2, ILT2/LIR-1, and LAG-2.

Embodiment H103. The method of embodiment H102, wherein the at least one of the one or more NK cell activating agent(s) that results in a decrease in the activation of PD-1 is an antagonistic antibody that binds specifically to PD-1, a soluble PD-1, a soluble PD-L1, or an antibody that binds specifically to PD-L1.

Embodiment H104. The method of embodiment H102, wherein at least one of the one or more NK cell activating agent(s) that results in a decrease in the activation of a TGF-β receptor is a soluble TGF-β receptor, an antibody that binds specifically to TGF-β, or an antagonistic antibody that binds specifically to a TGF-β receptor.

Embodiment H105. The method of embodiment H102, wherein at least one of the one or more NK cell activating agent(s) that results in a decrease in the activation of TIGIT is an antagonistic antibody that binds specifically to TIGIT, a soluble TIGIT, or an antibody that binds specifically to a ligand of TIGIT.

Embodiment H106. The method of embodiment H102, wherein at least one of the one or more NK cell activating agent(s) that results in a decrease in the activation of CD1 is an antagonistic antibody that binds specifically to CD1, a soluble CD1, or an antibody that binds specifically to a ligand of CD1.

Embodiment H107. The method of embodiment H102, wherein at least one of the one or more NK cell activating agent(s) that results in a decrease in the activation of TIM-3 is an antagonistic antibody that binds specifically to TIM-3, a soluble TIM-3, or an antibody that binds specifically to a ligand of TIM-3.

Embodiment H108. The method of embodiment H102, wherein at least one of the one or more NK cell activating agent(s) that results in a decrease in the activation of Siglec-7 is an antagonistic antibody that binds specifically to Siglec-7 or an antibody that binds specifically to a ligand of Siglec-7.

Embodiment H109. The method of embodiment H102, wherein at least one of the one or more NK cell activating agent(s) that results in a decrease in the activation of IRP60 is an antagonistic antibody that binds specifically to IRP60 or an antibody that binds specifically to a ligand of IRP60.

Embodiment H110. The method of embodiment H102, wherein at least one of the one or more NK cell activating agent(s) that results in a decrease in the activation of Tactile is an antagonistic antibody that binds specifically to Tactile or an antibody that binds specifically to a ligand of Tactile.

Embodiment H111. The method of embodiment H102, wherein at least one of the one or more NK cell activating agent(s) that results in a decrease in the activation of IL1R8 is an antagonistic antibody that binds specifically to IL1R8 or an antibody that binds specifically to a ligand of IL1R8.

Embodiment H112. The method of embodiment H102, wherein at least one of the one or more NK cell activating agent(s) that results in a decrease in the activation of NKG2A/KLRD1 is an antagonistic antibody that binds specifically to NKG2A/KLRD1 or an antibody that binds specifically to a ligand of NKG2A/KLRD1.

Embodiment H113. The method of embodiment H102, wherein at least one of the one or more NK cell activating agent(s) that results in a decrease in the activation of KIR2DL1 is an antagonistic antibody that binds specifically to KIR2DL1 or an antibody that binds specifically to a ligand of KIR2DL1.

Embodiment H114. The method of embodiment H102, wherein at least one of the one or more NK cell activating agent(s) that results in a decrease in the activation of KIR2DL2/3 is an antagonistic antibody that binds specifically to KIR2DL2/3 or an antibody that binds specifically to a ligand of KIR2DL2/3.

Embodiment H115. The method of embodiment H102, wherein at least one of the one or more NK cell activating agent(s) that results in a decrease in the activation of KIR2DL5 is an antagonistic antibody that binds specifically to KIR2DL5 or an antibody that binds specifically to a ligand of KIR2DL5.

Embodiment H116. The method of embodiment H102, wherein at least one of the one or more NK cell activating agent(s) that results in a decrease in the activation of KIR3DL1 is an antagonistic antibody that binds specifically to KIR3DL1 or an antibody that binds specifically to a ligand of KIR3DL1.

Embodiment H117. The method of embodiment H102, wherein at least one of the one or more NK cell activating agent(s) that results in a decrease in the activation of KIR3DL2 is an antagonistic antibody that binds specifically to KIR3DL2 or an antibody that binds specifically to a ligand of KIR3DL2.

Embodiment H118. The method of embodiment H102, wherein at least one of the one or more NK cell activating agent(s) that results in a decrease in the activation of ILT2/LIR-1 is an antagonistic antibody that binds specifically to ILT2/LIR-1 or an antibody that binds specifically to a ligand of ILT2/LIR-1.

Embodiment H119. The method of embodiment H102, wherein at least one of the one or more NK cell activating agent(s) that results in a decrease in the activation of LAG-2 is an antagonistic antibody that binds specifically to LAG-2 or an antibody that binds specifically to a ligand of LAG-2.

Embodiment H120. The method of any one of embodiments H1-H19, H35-H42, H44-H62, and H64-H77, wherein at least one of the one or more NK cell activating agent(s) is a single-chain chimeric polypeptide comprising:
 (i) a first target-binding domain;
 (ii) a soluble tissue factor domain; and
 (iii) a second target-binding domain.

Embodiment H121. The method of embodiment H120, wherein the first target-binding domain and the soluble tissue factor domain directly abut each other.

Embodiment H122. The method of embodiment H120, wherein the single-chain chimeric polypeptide further comprises a linker sequence between the first target-binding domain and the soluble tissue factor domain.

Embodiment H123. The method of any one of embodiments H120-H122, wherein the soluble tissue factor domain and the second target-binding domain directly abut each other.

Embodiment H124. The method of any one of embodiments H120-H122, wherein the single-chain chimeric polypeptide further comprises a linker sequence between the soluble tissue factor domain and the second target-binding domain.

Embodiment H125. The method of embodiment H120, wherein the first target-binding domain and the second target-binding domain directly abut each other.

Embodiment H126. The method of embodiment H120, wherein the single-chain chimeric polypeptide further comprises a linker sequence between the first target-binding domain and the second target-binding domain.

Embodiment H127. The method of embodiment H125 or H126, wherein the second target-binding domain and the soluble tissue factor domain directly abut each other.

Embodiment H128. The method of embodiment H125 or H126, wherein the single-chain chimeric polypeptide further comprises a linker sequence between the second target-binding domain and the soluble tissue factor domain.

Embodiment H129. The method of any one of embodiments H120-H128, wherein the first target-binding domain and the second target-binding domain bind specifically to the same antigen.

Embodiment H130. The method of embodiment H129, wherein the first target-binding domain and the second target-binding domain bind specifically to the same epitope.

Embodiment H131. The method of embodiment H130, wherein the first target-binding domain and the second target-binding domain comprise the same amino acid sequence.

Embodiment H132. The method of any one of embodiments H120-H128, wherein the first target-binding domain and the second target-binding domain bind specifically to different antigens.

Embodiment H133. The method of any one of embodiments H120-H32, wherein one or both of the first target-binding domain and the second target-binding domain is an antigen-binding domain.

Embodiment H134. The method of embodiment H133, wherein the first target-binding domain and the second target-binding domain are each an antigen-binding domain.

Embodiment H135. The method of embodiment H134, wherein antigen-binding domain comprises a scFv or a single domain antibody.

Embodiment H136. The method of any one of embodiments H120-H135, wherein one or both of the first target-binding domain and the second target-binding domain bind to a target selected from the group consisting of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKP30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

Embodiment H137. The method of any one of embodiments H120-H128, wherein one or both of the first target-binding domain and the second target-binding domain is a soluble interleukin or cytokine protein.

Embodiment H138. The method of embodiment H137, wherein the soluble interleukin or cytokine protein is selected from the group consisting of: IL-1, IL-2, IL-3, IL-7, IL-8, IL-10, IL-12, IL-15, IL-17, IL-18, IL-21, PDGF-DD, and SCF.

Embodiment H139. The method of any one of embodiments H120-H128, wherein one or both of the first target-binding domain and the second target-binding domain is a soluble interleukin or cytokine receptor.

Embodiment H140. The method of embodiment H139, wherein the soluble interleukin or cytokine receptor is a soluble TGF-β receptor II (TGF-βRII) a soluble TGF-βRIII, a soluble receptor for TNFα, a soluble receptor for IL-4, or a soluble receptor for IL-10.

Embodiment H141. The method of any one of embodiments H120-H140, wherein the soluble tissue factor domain is a soluble human tissue factor domain.

Embodiment H142. The method of embodiment H141, wherein the soluble human tissue factor domain comprises a sequence that is at least 80% identical to SEQ ID NO: 93.

Embodiment H143. The method of embodiment H142, wherein the soluble human tissue factor domain comprises a sequence that is at least 90% identical to SEQ ID NO: 93.

Embodiment H144. The method of embodiment H143, wherein the soluble human tissue factor domain comprises a sequence that is at least 95% identical to SEQ ID NO: 93.

Embodiment H145. The method of any one of embodiments H141-H144, wherein the soluble human tissue factor domain does not comprise one or more of:
- a lysine at an amino acid position that corresponds to amino acid position 20 of mature wildtype human tissue factor protein;
- an isoleucine at an amino acid position that corresponds to amino acid position 22 of mature wildtype human tissue factor protein;
- a tryptophan at an amino acid position that corresponds to amino acid position 45 of mature wildtype human tissue factor protein;
- an aspartic acid at an amino acid position that corresponds to amino acid position 58 of mature wildtype human tissue factor protein;
- a tyrosine at an amino acid position that corresponds to amino acid position 94 of mature wildtype human tissue factor protein;
- an arginine at an amino acid position that corresponds to amino acid position 135 of mature wildtype human tissue factor protein; and
- a phenylalanine at an amino acid position that corresponds to amino acid position 140 of mature wildtype human tissue factor protein.

Embodiment H146. The method of embodiment H145, wherein the soluble human tissue factor domain does not comprise any of:
- a lysine at an amino acid position that corresponds to amino acid position 20 of mature wildtype human tissue factor protein;
- an isoleucine at an amino acid position that corresponds to amino acid position 22 of mature wildtype human tissue factor protein;
- a tryptophan at an amino acid position that corresponds to amino acid position 45 of mature wildtype human tissue factor protein;
- an aspartic acid at an amino acid position that corresponds to amino acid position 58 of mature wildtype human tissue factor protein;
- a tyrosine at an amino acid position that corresponds to amino acid position 94 of mature wildtype human tissue factor protein;
- an arginine at an amino acid position that corresponds to amino acid position 135 of mature wildtype human tissue factor protein; and
- a phenylalanine at an amino acid position that corresponds to amino acid position 140 of mature wildtype human tissue factor protein.

Embodiment H147. The method of any one of embodiments H120-H146, wherein the soluble tissue factor domain is not capable of binding Factor VIIa.

Embodiment H148. The method of any one of embodiments H120-H147, wherein the soluble tissue factor domain does not convert inactive Factor X into Factor Xa.

Embodiment H149. The method of any one of embodiments H120-H148, wherein the single-chain chimeric polypeptide does not stimulate blood coagulation in a mammal.

Embodiment H150. The method of any one of embodiments H120-H149, wherein the single-chain chimeric polypeptide further comprises one or more additional target-binding domains at its N- and/or C-terminus.

Embodiment H151. The method of embodiment H150, wherein the single-chain chimeric polypeptide comprises one or more additional target-binding domains at its N-terminus.

Embodiment H152. The method of embodiment H151, wherein one or more additional target-binding domains directly abuts the first target-binding domain, the second target-binding domain, or the soluble tissue factor domain.

Embodiment H153. The method of embodiment H152, wherein the single-chain chimeric polypeptide further comprises a linker sequence between one of the at least one additional target-binding domains and the first target-binding domain, the second target-binding domain, or the soluble tissue factor domain.

Embodiment H154. The method of embodiment H150, wherein the single-chain chimeric polypeptide comprises one or more additional target-binding domains at its C-terminus.

Embodiment H155. The method of embodiment H154, wherein one of the one or more additional target-binding domains directly abuts the first target-binding domain, the second target-binding domain, or the soluble tissue factor domain.

Embodiment H156. The method of embodiment H154, wherein the single-chain chimeric polypeptide further comprises a linker sequence between one of the at least one additional target-binding domains and the first target-binding domain, the second target-binding domain, or the soluble tissue factor domain.

Embodiment H157. The method of embodiment H150, wherein the single-chain chimeric polypeptide comprises one or more additional target binding domains at its N-terminus and the C-terminus.

Embodiment H158. The method of embodiment H157, wherein one of the one or more additional antigen binding domains at the N-terminus directly abuts the first target-binding domain, the second target-binding domain, or the soluble tissue factor domain.

Embodiment H159. The method of embodiment H157, wherein the single-chain chimeric polypeptide further comprises a linker sequence between one of the one or more additional antigen-binding domains at the N-terminus and the first target-binding domain, the second target-binding domain, or the soluble tissue factor domain.

Embodiment H160. The method of embodiment H157, wherein one of the one or more additional antigen binding domains at the C-terminus directly abuts the first target-binding domain, the second target-binding domain, or the soluble tissue factor domain.

Embodiment H161. The method of embodiment H157, wherein the single-chain chimeric polypeptide further comprises a linker sequence between one of the one or more additional antigen-binding domains at the C-terminus and the first target-binding domain, the second target-binding domain, or the soluble tissue factor domain.

Embodiment H162. The method of any one of embodiments H150-H161, wherein two or more of the first target-binding domain, the second target-binding domain, and the one or more additional target-binding domains bind specifically to the same antigen.

Embodiment H163. The method of embodiment H162, wherein two or more of the first target-binding domain, the second target-binding domain, and the one or more additional target-binding domains bind specifically to the same epitope.

Embodiment H164. The method of embodiment H163, wherein two or more of the first target-binding domain, the second target-binding domain, and the one or more additional target-binding domains comprise the same amino acid sequence.

Embodiment H165. The method of embodiment H162, wherein the first target-binding domain, the second target-binding domain, and the one or more additional target-binding domains each bind specifically to the same antigen.

Embodiment H166. The method of embodiment H165, wherein the first target-binding domain, the second target-binding domain, and the one or more additional target-binding domains each bind specifically to the same epitope.

Embodiment H167. The method of embodiment H166, wherein the first target-binding domain, the second target-binding domain, and the one or more additional target-binding domains each comprise the same amino acid sequence.

Embodiment H168. The method of any one of embodiments H150-H161, wherein the first target-binding domain, the second target-binding domain, and the one or more additional target-binding domains bind specifically to different antigens.

Embodiment H169. The method of any one of embodiments H150-H168, wherein one or more of the first target-binding domain, the second target-binding domain, and the one or more target-binding domains is an antigen-binding domain.

Embodiment H170. The method of embodiment H169, wherein the first target-binding domain, the second target-binding domain, and the one or more additional target-binding domains are each an antigen-binding domain.

Embodiment H171. The method of embodiment H170, wherein antigen-binding domain comprises a scFv or a single domain antibody.

Embodiment H172. The method of any one of embodiments H150-H171, wherein one or more of the first target-binding domain, the second target-binding domain, and the one or more target-binding domains bind specifically to a target selected from the group consisting of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKP30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

Embodiment H173. The method of any one of embodiments H150-H161, wherein one or more of the first target-binding domain, the second target-binding domain, and the one or more additional target-binding domains is a soluble interleukin or cytokine protein.

Embodiment H174. The method of embodiment H173, wherein the soluble interleukin or cytokine protein is selected from the group consisting of: IL-1, IL-2, IL-3, IL-7, IL-8, IL-10, IL-12, IL-15, IL-17, IL-18, IL-21, PDGF-DD, and SCF.

Embodiment H175. The method of any one of embodiments H150-H161, wherein one or more of the first target-binding domain, the second target-binding domain, and the one or more additional target-binding domains is a soluble interleukin or cytokine receptor.

Embodiment H176. The method of embodiment H175, wherein the soluble receptor is a soluble TGF-β receptor II (TGF-βRII) a soluble TGF-βRIII, a soluble receptor for TNFα, a soluble receptor for IL-4, or a soluble receptor for IL-10.

Embodiment H177. The method of any one of embodiments H1-H19, H35-H42, H44-H62, and H64-H77, wherein at least one of the one or more NK cell activating agent(s) is a multi-chain chimeric polypeptide comprising:
(c) a first chimeric polypeptide comprising:
(i) a first target-binding domain;
(ii) a soluble tissue factor domain; and
(iii) a first domain of a pair of affinity domains;
(d) a second chimeric polypeptide comprising:
(i) a second domain of a pair of affinity domains; and
(ii) a second target-binding domain,
wherein the first chimeric polypeptide and the second chimeric polypeptide associate through the binding of the first domain and the second domain of the pair of affinity domains.

Embodiment H178. The method of embodiment H177, wherein the first target-binding domain and the soluble tissue factor domain directly abut each other in the first chimeric polypeptide.

Embodiment H179. The method of embodiment H177, wherein the first chimeric polypeptide further comprises a linker sequence between the first target-binding domain and the soluble tissue factor domain in the first chimeric polypeptide.

Embodiment H180. The method of any one of embodiments H177-H179, wherein the soluble tissue factor domain and the first domain of the pair of affinity domains directly abut each other in the first chimeric polypeptide.

Embodiment H181. The method of any one of embodiments H177-H179, wherein the first chimeric polypeptide further comprises a linker sequence between the soluble tissue factor domain and the first domain of the pair of affinity domains in the first chimeric polypeptide.

Embodiment H182. The method of any one of embodiments H177-H181, wherein the second domain of the pair of affinity domains and the second target-binding domain directly abut each other in the second chimeric polypeptide.

Embodiment H183. The method of any one of embodiments H177-H181, wherein second chimeric polypeptide further comprises a linker sequence between the second domain of the pair of affinity domains and the second target-binding domain in the second chimeric polypeptide.

Embodiment H184. The method of any one of embodiments H177-H183, wherein the first target-binding domain and the second target-binding domain bind specifically to the same antigen.

Embodiment H185. The method of embodiment H184, wherein the first target-binding domain and the second target-binding domain bind specifically to the same epitope.

Embodiment H186. The method of embodiment H185, wherein the first target-binding domain and the second target-binding domain comprise the same amino acid sequence.

Embodiment H187. The method of any one of embodiments H177-H183, wherein the first target-binding domain and the second target-binding domain bind specifically to different antigens.

Embodiment H188. The method of any one of embodiments H177-H187, wherein one or both of the first target-binding domain and the second target-binding domain is an antigen-binding domain.

Embodiment H189. The method of embodiment H188, wherein the first target-binding domain and the second target-binding domain are each antigen-binding domains.

Embodiment H190. The method of embodiment H188 or H189, wherein antigen-binding domain comprises a scFv or a single domain antibody.

Embodiment H191. The method of any one of embodiments H177-H190, wherein one or both of the first target-binding domain and the second target-binding domain bind specifically to a target selected from the group consisting of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKP30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

Embodiment H192. The method of any one of embodiments H177-H183, wherein one or both of the first target-binding domain and the second target-binding domain is a soluble interleukin or cytokine protein.

Embodiment H193. The method of embodiment H192, wherein the soluble interleukin or cytokine protein is selected from the group consisting of: IL-1, IL-2, IL-3, IL-7, IL-8, IL-10, IL-12, IL-15, IL-17, IL-18, IL-21, PDGF-DD, and SCF.

Embodiment H194. The method of any one of embodiments H177-H183, wherein one or both of the first target-binding domain and the second target-binding domain is a soluble interleukin or cytokine receptor.

Embodiment H195. The method of embodiment H194, wherein the soluble receptor is a soluble TGF-β receptor II (TGF-βRII) a soluble TGF-βRIII, a soluble receptor for TNFα, a soluble receptor for IL-4, or a soluble receptor for IL-10.

Embodiment H196. The method of any one of embodiments H177-H195, wherein the first chimeric polypeptide further comprises one or more additional target-binding domain(s), where at least one of the one or more additional antigen-binding domain(s) is positioned between the soluble tissue factor domain and the first domain of the pair of affinity domains.

Embodiment H197. The method of embodiment H196, wherein the first chimeric polypeptide further comprises a linker sequence between the soluble tissue factor domain and the at least one of the one or more additional antigen-binding domain(s), and/or a linker sequence between the at least one of the one or more additional antigen-binding domain(s) and the first domain of the pair of affinity domains.

Embodiment H198. The method of any one of embodiments H177-H195, wherein the first chimeric polypeptide further comprises one or more additional target-binding domains at the N-terminal and/or C-terminal end of the first chimeric polypeptide.

Embodiment H199. The method of embodiment H198, wherein at least one of the one or more additional target-binding domains directly abuts the first domain of the pair of affinity domains in the first chimeric polypeptide.

Embodiment H200. The method of embodiment H198, wherein the first chimeric polypeptide further comprises a linker sequence between the at least one of the one or more additional target-binding domains and the first domain of the pair of affinity domains.

Embodiment H201. The method of embodiment H198, wherein the at least one of the one or more additional target-binding domains directly abuts the first target-binding domain in the first chimeric polypeptide.

Embodiment H202. The method of embodiment H198, wherein the first chimeric polypeptide further comprises a linker sequence between the at least one of the one or more additional target-binding domains and the first target-binding domain.

Embodiment H203. The method of embodiment H198, wherein at least one of the one or more additional target-binding domains is disposed at the N- and/or C-terminus of the first chimeric polypeptide, and at least one of the one or more additional target-binding domains is positioned between the soluble tissue factor domain and the first domain of the pair of affinity domains in the first chimeric polypeptide.

Embodiment H204. The method of embodiment H203, wherein the at least one additional target-binding domain of the one or more additional target-binding domains disposed at the N-terminus directly abuts the first target-binding domain or the first domain of the pair of affinity domains in the first chimeric polypeptide.

Embodiment H205. The method of embodiment H203, wherein the first chimeric polypeptide further comprises a linker sequence disposed between the at least one additional target-binding domain and the first target-binding domain or the first domain of the pair of affinity domains in the first chimeric polypeptide.

Embodiment H206. The method of embodiment H203, wherein the at least one additional target-binding domain of the one or more additional target-binding domains disposed at the C-terminus directly abuts the first target-binding domain or the first domain of the pair of affinity domains in the first chimeric polypeptide.

Embodiment H207. The method of embodiment H203, wherein the first chimeric polypeptide further comprises a linker sequence disposed between the at least one additional target-binding domain and the first target-binding domain or the first domain of the pair of affinity domains in the first chimeric polypeptide.

Embodiment H208. The method of embodiment H203, wherein the at least one of the one or more additional target-binding domains positioned between the soluble tissue factor domain and the first domain of the pair of affinity domains, directly abuts the soluble tissue factor domain and/or the first domain of the pair of affinity domains.

Embodiment H209. The method of embodiment H203, wherein the first chimeric polypeptide further comprises a linker sequence disposed (i) between the soluble tissue factor domain and the at least one of the one or more additional target-binding domains positioned between the soluble tissue factor domain and the first domain of the pair of affinity domains, and/or (ii) between the first domain of the pair of affinity domains and the at least one of the one or more additional target-binding domains positioned between the soluble tissue factor domain and the first domain of the pair of affinity domains.

Embodiment H210. The method of any one of embodiments H177-H209, wherein the second chimeric polypeptide further comprises one or more additional target-binding domains at the N-terminal end or the C-terminal end of the second chimeric polypeptide.

Embodiment H211. The method of embodiment H210, wherein at least one of the one or more additional target-binding domains directly abuts the second domain of the pair of affinity domains in the second chimeric polypeptide.

Embodiment H212. The method of embodiment H210, wherein the second chimeric polypeptide further comprises a linker sequence between at least one of the one or more additional target-binding domains and the second domain of the pair of affinity domains in the second chimeric polypeptide.

Embodiment H213. The method of embodiment H210, wherein at least one of the one or more additional target-binding domains directly abuts the second target-binding domain in the second chimeric polypeptide.

Embodiment H214. The method of embodiment H210, wherein the second chimeric polypeptide further comprises a linker sequence between at least one of the one or more additional target-binding domains and the second target-binding domain in the second chimeric polypeptide.

Embodiment H215. The method of any one of embodiments H196-H214, wherein two or more of the first target-binding domain, the second target-binding domain, and the one or more additional target-binding domains bind specifically to the same antigen.

Embodiment H216. The method of embodiment H215, wherein two or more of the first target-binding domain, the second target-binding domain, and the one or more additional target-binding domains bind specifically to the same epitope.

Embodiment H217. The method of embodiment H216, wherein two or more of the first target-binding domain, the second target-binding domain, and the one or more additional target-binding domains comprise the same amino acid sequence.

Embodiment H218. The method of embodiment H215, wherein the first target-binding domain, the second target-binding domain, and the one or more additional target-binding domains each bind specifically to the same antigen.

Embodiment H219. The method of embodiment H218, wherein the first target-binding domain, the second target-binding domain, and the one or more additional target-binding domains each bind specifically to the same epitope.

Embodiment H220. The method of embodiment H219, wherein the first target-binding domain, the second target-binding domain, and the one or more additional target-binding domains each comprise the same amino acid sequence.

Embodiment H221. The method of any one of embodiments H196-H214, wherein the first target-binding domain, the second target-binding domain, and the one or more additional target-binding domains bind specifically to different antigens.

Embodiment H222. The method of any one of embodiments H196-H221, wherein one or more of the first target-binding domain, the second target-binding domain, and the one or more target-binding domains is an antigen-binding domain.

Embodiment H223. The method of embodiment H222, wherein the first target-binding domain, the second target-binding domain, and the one or more additional target-binding domains are each an antigen-binding domain.

Embodiment H224. The method of embodiment H223, wherein antigen-binding domain comprises a scFv.

Embodiment H225. The method of any one of embodiments H196-H224, wherein one or more of the first target-binding domain, the second target-binding domain, and the one or more target-binding domains bind specifically to a target selected from the group consisting of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

Embodiment H226. The method of any one of embodiments H196-H214, wherein one or more of the first target-binding domain, the second target-binding domain, and the one or more additional target-binding domains is a soluble interleukin or cytokine protein.

Embodiment H227. The method of embodiment H226, wherein the soluble interleukin or cytokine protein is selected from the group consisting of: IL-1, IL-2, IL-3, IL-7, IL-8, IL-10, IL-12, IL-15, IL-17, IL-18, IL-21, PDGF-DD, and SCF.

Embodiment H228. The method of any one of embodiments H196-H214, wherein one or more of the first target-binding domain, the second target-binding domain, and the one or more additional target-binding domains is a soluble interleukin or cytokine receptor.

Embodiment H229. The method of embodiment H228, wherein the soluble receptor a soluble TGF-β receptor II (TGF-βRII) a soluble TGF-βRIII, a soluble receptor for TNFα, a soluble receptor for IL-4, or a soluble receptor for IL-10.

Embodiment H230. The method of any one of embodiments H196-H229, wherein the soluble tissue factor domain is a soluble human tissue factor domain.

Embodiment H231. The method of embodiment H230, wherein the soluble human tissue factor domain comprises a sequence that is at least 80% identical to SEQ ID NO: 93.

Embodiment H232. The method of embodiment H231, wherein the soluble human tissue factor domain comprises a sequence that is at least 90% identical to SEQ ID NO: 93.

Embodiment H233. The method of embodiment H232, wherein the soluble human tissue factor domain comprises a sequence that is at least 95% identical to SEQ ID NO: 93.

Embodiment H234. The method of any one of embodiments H230-H233, wherein the soluble human tissue factor domain does not comprise one or more of:
- a lysine at an amino acid position that corresponds to amino acid position 20 of mature wildtype human tissue factor protein;
- an isoleucine at an amino acid position that corresponds to amino acid position 22 of mature wildtype human tissue factor protein;
- a tryptophan at an amino acid position that corresponds to amino acid position 45 of mature wildtype human tissue factor protein;
- an aspartic acid at an amino acid position that corresponds to amino acid position 58 of mature wildtype human tissue factor protein;
- a tyrosine at an amino acid position that corresponds to amino acid position 94 of mature wildtype human tissue factor protein;
- an arginine at an amino acid position that corresponds to amino acid position 135 of mature wildtype human tissue factor protein; and
- a phenylalanine at an amino acid position that corresponds to amino acid position 140 of mature wildtype human tissue factor protein.

Embodiment H235. The method of embodiment H234, wherein the soluble human tissue factor domain does not comprise any of:
- a lysine at an amino acid position that corresponds to amino acid position 20 of mature wildtype human tissue factor protein;
- an isoleucine at an amino acid position that corresponds to amino acid position 22 of mature wildtype human tissue factor protein;
- a tryptophan at an amino acid position that corresponds to amino acid position 45 of mature wildtype human tissue factor protein;
- an aspartic acid at an amino acid position that corresponds to amino acid position 58 of mature wildtype human tissue factor protein;
- a tyrosine at an amino acid position that corresponds to amino acid position 94 of mature wildtype human tissue factor protein;
- an arginine at an amino acid position that corresponds to amino acid position 135 of mature wildtype human tissue factor protein; and
- a phenylalanine at an amino acid position that corresponds to amino acid position 140 of mature wildtype human tissue factor protein.

Embodiment H236. The method of any one of embodiments H196-H235, wherein the soluble tissue factor domain is not capable of binding to Factor VIIa.

Embodiment H237. The method of any one of embodiments H196-H236, wherein the soluble tissue factor domain does not convert inactive Factor X into Factor Xa.

Embodiment H238. The method of any one of embodiments H196-H237, wherein the multi-chain chimeric polypeptide does not stimulate blood coagulation in a mammal.

Embodiment H239. The method of any one of embodiments H196-H238, wherein the pair of affinity domains is a sushi domain from an alpha chain of human IL-15 receptor (IL-15Rα) and a soluble IL-15.

Embodiment H240. The method of embodiment H239, wherein the soluble IL-15 has a D8N or D8A amino acid substitution.

Embodiment H241. The method of embodiment H239 or H240, wherein the human IL-15Rα is a mature full-length IL-15Rα.

Embodiment H242. The method of any one of embodiments H196-H238, wherein the pair of affinity domains is selected from the group consisting of: barnase and barnstar, a PKA and an AKAP, adapter/docking tag modules based on mutated RNase I fragments, and SNARE modules based on interactions of the proteins syntaxin, synaptotagmin, synaptobrevin, and SNAP25.

Embodiment H243. The method of any one of embodiments H1-H19, H35-H42, H44-H62, and H64-H77, wherein at least one of the one or more NK cell activating agent(s) is a multi-chain chimeric polypeptide comprising:
(a) a first and second chimeric polypeptides, wherein each comprises:
  (i) a first target-binding domain;
  (ii) a Fc domain; and
  (iii) a first domain of a pair of affinity domains;
(b) a third and fourth chimeric polypeptide, wherein each comprises:
  (i) a second domain of a pair of affinity domains; and
  (ii) a second target-binding domain,
wherein the first and second chimeric polypeptides and the third and fourth chimeric polypeptides associate through the binding of the first domain and the second domain of the pair of affinity domains, and the first and second chimeric polypeptides associate through their Fc domains.

Embodiment H244. The method of embodiment H243, wherein the first target-binding domain and the Fc domain directly abut each other in the first and second chimeric polypeptides.

Embodiment H245. The method of embodiment H243, wherein the first and second chimeric polypeptides further comprise a linker sequence between the first target-binding domain and the Fc domain in the first and second chimeric polypeptides.

Embodiment H246. The method of any one of embodiments H243-H245, wherein the Fc domain and the first domain of the pair of affinity domains directly abut each other in the first and second chimeric polypeptides.

Embodiment H247. The method of any one of embodiments H243-H245, wherein the first chimeric polypeptide further comprises a linker sequence between the Fc domain and the first domain of the pair of affinity domains in the first and second chimeric polypeptides.

Embodiment H248. The method of any one of embodiments H243-H247, wherein the second domain of the pair of affinity domains and the second target-binding domain directly abut each other in the third and fourth chimeric polypeptides.

Embodiment H249. The method of any one of embodiments H243-H247, wherein third and fourth chimeric polypeptides further comprise a linker sequence between the second domain of the pair of affinity domains and the second target-binding domain in the third and fourth chimeric polypeptides.

Embodiment H250. The method of any one of embodiments H243-H249, wherein the first target-binding domain and the second target-binding domain bind specifically to the same antigen.

Embodiment H251. The method of embodiment H250, wherein the first target-binding domain and the second target-binding domain bind specifically to the same epitope.

Embodiment H252. The method of embodiment H251, wherein the first target-binding domain and the second target-binding domain comprise the same amino acid sequence.

Embodiment H253. The method of any one of embodiments H243-H249, wherein the first target-binding domain and the second target-binding domain bind specifically to different antigens.

Embodiment H254. The method of any one of embodiments H243-H253, wherein one or both of the first target-binding domain and the second target-binding domain is an antigen-binding domain.

Embodiment H255. The method of embodiment H254, wherein the first target-binding domain and the second target-binding domain are each antigen-binding domains.

Embodiment H256. The method of embodiment H254 or H255, wherein antigen-binding domain comprises a scFv or a single domain antibody.

Embodiment H257. The method of any one of embodiments H243-H256, wherein one or both of the first target-binding domain and the second target-binding domain bind specifically to a target selected from the group consisting of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7H3, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

Embodiment H258. The method of any one of embodiments H243-H256, wherein one or both of the first target-binding domain and the second target-binding domain is a soluble interleukin or cytokine protein.

Embodiment H259. The method of embodiment H258, wherein the soluble interleukin or cytokine protein is selected from the group consisting of: IL-1, IL-2, IL-3, IL-7, IL-8, IL-10, IL-12, IL-15, IL-17, IL-18, IL-21, PDGF-DD, and SCF.

Embodiment H260. The method of any one of embodiments H243-H256, wherein one or both of the first target-binding domain and the second target-binding domain is a soluble interleukin or cytokine receptor.

Embodiment H261. The method of embodiment H260, wherein the soluble receptor is a soluble TGF-β receptor II (TGF-βRII) a soluble TGF-βRIII, a soluble receptor for TNFα, a soluble receptor for IL-4, or a soluble receptor for IL-10.

Embodiment I1. A method of treating an aging-related disease or condition in a subject in need thereof, the method comprising administering to a subject identified as having an aging-related disease or condition a therapeutically effective amount of one or more natural killer (NK) cell activating agent(s).

Embodiment I2. A method of killing or reducing the number of senescent cells in a subject in need thereof, the method comprising administering to the subject a therapeutically effective amount of one or more NK cell activating agent(s).

Embodiment I3. The method of embodiment I1 or I2, wherein the administering results in a decrease in the number of senescent cells in a target tissue in the subject.

Embodiment I4. The method of embodiment I3, wherein the target tissue is selected from the group consisting of: adipose tissue, pancreatic tissue, liver tissue, lung tissue, vasculature, bone tissue, central nervous system (CNS) tissue, eye tissue, skin tissue, muscle tissue, and secondary lympho-organ tissue.

Embodiment I5. A method of treating an aging-related disease or condition in a subject in need thereof, the method comprising administering to a subject identified as having an aging-related disease or condition a therapeutically effective number of activated NK cells.

Embodiment I6. A method of killing or reducing the number of senescent cells in a subject in need thereof, the method comprising administering to the subject a therapeutically effective number of activated NK cells.

Embodiment I7. The method of any one of embodiments I1-I6, wherein the subject has been identified or diagnosed as having an aging-related disease or condition.

Embodiment I8. The method of embodiment I7, wherein the aging-related disease or condition is selected from the group consisting of: a cancer, an autoimmune disease, a metabolic disease, a neurodegenerative disease, a cardiovascular disease, a skin disease, a progeria disease, and a fragility disease.

Embodiment I9. The method of embodiment I8, wherein the cancer is selected from the group consisting of: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, B-cell lymphoma, B-cell non-Hodgkin's lymphoma, Hodgkin's lymphoma, chronic lymphocytic leukemia (CLL), acute myeloid leukemia (AML), chronic myeloid leukemia (CML), acute lymphocytic leukemia (ALL), myelodysplastic syndromes (MDS), cutaneous T-cell lymphoma, retinoblastoma, stomach cancer, urothelial carcinoma, lung cancer, renal cell carcinoma, gastric and esophageal cancer, pancreatic cancer, prostate cancer, breast cancer, colorectal cancer, ovarian cancer, non-small cell lung carcinoma, squamous cell head and neck carcinoma, endometrial cancer, cervical cancer, liver cancer, and hepatocellular carcinoma.

Embodiment I10. The method of embodiment I8, wherein the autoimmune disease is type-1 diabetes.

Embodiment I11. The method of embodiment I8, wherein the metabolic disease is selected from the group consisting of: obesity, a lipodystrophy, and type 2 diabetes mellitus.

Embodiment I12. The method of embodiment I8, wherein the neurodegenerative disease is selected from the group consisting of: Alzheimer's disease, Parkinson's disease, amyotrophic lateral sclerosis, and dementia.

Embodiment I13. The method of embodiment I8, wherein the cardiovascular disease is selected from the group consisting of: coronary artery disease, atherosclerosis, and pulmonary arterial hypertension.

Embodiment I14. The method of embodiment I8, wherein the skin disease is selected from the group consisting of: wound healing, alopecia, wrinkles, senile lentigo, skin thinning, xeroderma pigmentosum, and dyskeratosis congenita.

Embodiment I15. The method of embodiment I8, wherein the progeria disease is selected from the group consisting of: progeria and Hutchinson-Gilford Progeria Syndrome.

Embodiment I16. The method of embodiment I8, wherein the fragility disease is selected from the group consisting of: frailty, responsiveness to vaccination, osteoporosis, and sarcopenia.

Embodiment I17. The method of any one of embodiments I1-I6, wherein the aging-related disease or condition is selected from the group consisting of: osteoarthritis, adipose atrophy, chronic obstructive pulmonary disease, idiopathic pulmonary fibrosis, kidney transplant failure, liver fibrosis, loss of bone mass, sarcopenia, age-associated loss of lung tissue elasticity, osteoporosis, age-associated renal dysfunction, and chemical-induced renal dysfunction.

Embodiments I18. The method of any one of embodiments I1-I6, wherein the aging-related disease or condition is type 2 diabetes or atherosclerosis.

Embodiments I19. A method of improving the texture and/or appearance of skin and/or hair in a subject in need thereof over a period of time, the method comprising administering to the subject a therapeutically effective amount of one or more natural killer (NK) cell activating agent(s).

Embodiment I20. A method of improving the texture and/or appearance of skin and/or hair in a subject in need thereof over a period of time, the method comprising administering to the subject a therapeutically effective number of activated NK cells.

Embodiment I21. The method of embodiment I19 or I20, wherein the method provides for an improvement in the texture and/or appearance of skin of the subject over the period of time.

Embodiment I22. The method of embodiment I21, wherein the method results in a decrease in the rate of formation of wrinkles in the skin of the subject over the period of time.

Embodiment I23. The method of embodiment I21 or I22, wherein the method results in an improvement in the coloration of skin of the subject over the period of time.

Embodiment I24. The method of any one of embodiments I21-I23, wherein the method results in an improvement in the texture of skin of the subject over the period of time.

Embodiment I25. The method of any one of embodiments I20-I24, wherein the method provides for an improvement in the texture and/or appearance of hair of the subject over the period of time.

Embodiment I26. The method of embodiment I25, wherein the method results in a decrease in the rate of formation of gray hair in the subject over the period of time.

Embodiment I27. The method of embodiment I25 or I26, wherein the method results in a decrease in the number of gray hairs of the subject over the period of time.

Embodiment I28. The method of any one of embodiments I25-I27, wherein the method results in a decrease in the rate of hair loss in the subject over time.

Embodiment I29. The method of any one of embodiments I25-I28, wherein the method results in an improvement in the texture of hair of the subject over the period of time.

Embodiment I30. The method of any one of embodiments I19-I29, wherein the method results in a decrease in the number of senescent dermal fibroblasts in the skin of the subject over the period of time.

Embodiment I31. A method of assisting in the treatment of obesity in a subject in need thereof over a period of time, the method comprising administering to the subject a therapeutically effective amount of one or more natural killer (NK) cell activating agent(s).

Embodiment I32. A method of assisting in the treatment of obesity in a subject in need thereof over a period of time, the method comprising administering to the subject a therapeutically effective number of activated NK cells.

Embodiment I33. The method of any one of embodiments I1-I32, wherein the method further comprises:
obtaining a resting NK cell; and
contacting the resting NK cell in vitro in a liquid culture medium comprising one or more NK cell activating agent(s), wherein the contacting results in the generation of the activated NK cells that are subsequently administered to the subject.

Embodiment I34. The method of embodiment I33, wherein the resting NK cell is a genetically-engineered NK cell carrying a chimeric antigen receptor or recombinant T cell receptor.

Embodiment I35. The method of embodiment I33, wherein the method further comprises introducing a nucleic acid that encodes a chimeric antigen receptor or a recombinant T cell receptor into the resting NK cell or the activated NK cell prior to administration to the subject.

Embodiment I36. The method of any one of embodiments I31-I35, wherein the method results in a decrease in the mass of the subject over the period of time.

Embodiment I37. The method of any one of embodiments I31-I36, wherein the method results in a decrease in the body mass index (BMI) of the subject over the period of time.

Embodiment I38. The method of any one of embodiments I31-I35, wherein the method results in a decrease in the rate of progression from pre-diabetes to type 2 diabetes in the subject.

Embodiment I39. The method of any one of embodiments I31-I35, wherein the method results in a decrease in fasting serum glucose level in the subject.

Embodiment I40. The method of any one of embodiments I31-I35, wherein the method results in an increase in insulin sensitivity in the subject.

Embodiment I41. The method of any one of embodiments I31-I35, wherein the method results in a decrease in the severity of atherosclerosis in the subject.

Embodiment I42. The method of any one of embodiments I1-I41, wherein at least one of the one or more NK cell activating agent(s) results in activation of one or more of: a receptor for IL-2, a receptor for IL-7, a receptor for IL-12, a receptor for IL-15, a receptor for IL-18, a receptor for IL-21, a receptor for IL-33, CD16, CD69, CD25, CD36, CD59, CD352, NKp80, DNAM-1, 2B4, NKp30, NKp44, NKp46, NKG2D, KIR2DS1, KIR2Ds2/3, KIR2DL4, KIR2DS4, KIR2DS5, and KIR3DS1.

Embodiment I43. The method of any one of embodiments I1-I42, wherein at least one of the one or more NK cell activating agent(s) results in a decrease in the activation of one or more of: PD-1, a TGF-β receptor, TIGIT, CD1, TIM-3, Siglec-7, IRP60, Tactile, IL1R8, NKG2A/KLRD1, KIR2DL1, KIR2DL2/3, KIR2DL5, KIR3DL1, KIR3DL2, ILT2/LIR-1, and LAG-2.

Embodiment I44. The method of any one of embodiments I1-I41, wherein at least one of the one or more NK cell activating agent(s) is a single-chain chimeric polypeptide comprising:
(i) a first target-binding domain;
(ii) a soluble tissue factor domain; and
(iii) a second target-binding domain.

Embodiment I45. The method of embodiment I44, wherein the first target-binding domain and the soluble tissue factor domain directly abut each other.

Embodiment I46. The method of embodiment I44, wherein the single-chain chimeric polypeptide further comprises a linker sequence between the first target-binding domain and the soluble tissue factor domain.

Embodiment I47. The method of any one of embodiments I44-I46, wherein the soluble tissue factor domain and the second target-binding domain directly abut each other.

Embodiment I48. The method of any one of embodiments I44-I46, wherein the single-chain chimeric polypeptide further comprises a linker sequence between the soluble tissue factor domain and the second target-binding domain.

Embodiment I49. The method of any one of embodiments I1-I41, wherein at least one of the one or more NK cell activating agent(s) is a multi-chain chimeric polypeptide comprising:
(a) a first chimeric polypeptide comprising:
(i) a first target-binding domain;
(ii) a soluble tissue factor domain; and
(iii) a first domain of a pair of affinity domains;
(b) a second chimeric polypeptide comprising:
(i) a second domain of a pair of affinity domains; and
(ii) a second target-binding domain,
wherein the first chimeric polypeptide and the second chimeric polypeptide associate through the binding of the first domain and the second domain of the pair of affinity domains.

Embodiment I50. The method of embodiment I49, wherein the first target-binding domain and the soluble tissue factor domain directly abut each other in the first chimeric polypeptide.

Embodiment I51. The method of embodiment I49, wherein the first chimeric polypeptide further comprises a linker sequence between the first target-binding domain and the soluble tissue factor domain in the first chimeric polypeptide.

Embodiment I52. The method of any one of embodiments I49-I51, wherein the soluble tissue factor domain and the first domain of the pair of affinity domains directly abut each other in the first chimeric polypeptide.

Embodiment I53. The method of any one of embodiments I49-I51, wherein the first chimeric polypeptide further comprises a linker sequence between the soluble tissue factor domain and the first domain of the pair of affinity domains in the first chimeric polypeptide.

Embodiment I54. The method of any one of embodiments I49-I53, wherein the second domain of the pair of affinity domains and the second target-binding domain directly abut each other in the second chimeric polypeptide.

Embodiment I55. The method of any one of embodiments I49-I53, wherein second chimeric polypeptide further comprises a linker sequence between the second domain of the pair of affinity domains and the second target-binding domain in the second chimeric polypeptide.

Embodiment I56. The method of any one of embodiments I1-I41, wherein at least one of the one or more NK cell activating agent(s) is a multi-chain chimeric polypeptide comprising:
(a) a first and second chimeric polypeptides, wherein each comprises:
(i) a first target-binding domain;
(ii) a Fc domain; and
(iii) a first domain of a pair of affinity domains;
(b) a third and fourth chimeric polypeptide, wherein each comprises:
(i) a second domain of a pair of affinity domains; and
(ii) a second target-binding domain,
wherein the first and second chimeric polypeptides and the third and fourth chimeric polypeptides associate through the binding of the first domain and the second domain of the pair of affinity domains, and the first and second chimeric polypeptides associate through their Fc domains.

Embodiment I57. The method of any one of embodiments I44-I56, wherein one or both of the first target-binding domain and the second target-binding domain bind specifically to a target selected from the group consisting of: CD16a, CD33, CD20, CD19, CD22, CD123, PDL-1, TIGIT, PD-1, TIM3, CTLA4, MICA, MICB, IL-6, IL-8, TNFα, CD26, CD36, ULBP2, CD30, CD200, IGF-1R, MUC4AC, MUC5AC, Trop-2, CMET, EGFR, HER1, HER2, HER3, PSMA, CEA, B7113, EPCAM, BCMA, P-cadherin, CEACAM5, a UL16-binding protein, HLA-DR, DLL4, TYRO3, AXL, MER, CD122, CD155, PDGF-DD, a ligand of TGF-β receptor II (TGF-βRII), a ligand of TGF-βRIII, a ligand of DNAM1, a ligand of NKp46, a ligand of NKp44, a ligand of NKG2D, a ligand of NKp30, a ligand for a scMHCI, a ligand for a scMHCII, a ligand for a scTCR, a receptor for PDGF-DD, a receptor for stem cell factor (SCF), a receptor for stem cell-like tyrosine kinase 3 ligand (FLT3L), a receptor for MICA, a receptor for MICB, a receptor for a ULP16-binding protein, a receptor for CD155, and a receptor for CD122.

Embodiment I58. The method of any one of embodiments I44-I56, wherein one or both of the first target-binding domain and the second target-binding domain is a soluble interleukin or cytokine protein.

Embodiment I59. The method of embodiment I58, wherein the soluble interleukin or cytokine protein is selected from the group consisting of: IL-1, IL-2, IL-3, IL-7, IL-8, IL-10, IL-12, IL-15, IL-17, IL-18, IL-21, PDGF-DD, and SCF.

Embodiment I60. The method of any one of embodiments I44-I56, wherein one or both of the first target-binding domain and the second target-binding domain is a soluble interleukin or cytokine receptor.

Embodiment I61. The method of embodiment I60, wherein the soluble receptor is a soluble TGF-β receptor II (TGF-βRII) a soluble TGF-βRIII, a soluble receptor for TNFα, a soluble receptor for IL-4, or a soluble receptor for IL-10.

Embodiment I62. The method of any one of embodiments I44-I55, wherein the soluble tissue factor domain is a soluble human tissue factor domain that does not stimulate blood coagulation.

Embodiment I63. The method of any one of embodiments I43-I55, wherein the soluble tissue factor domain comprises or consists of a sequence from a wild-type soluble human tissue factor.

SEQUENCE LISTING (336 sequences)

SEQ ID NO: 1 - protein, 251 aa, Homo sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 2 - DNA, 753 bp, Homo sapiens
gagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatc

SEQ ID NO: 3 - protein, 199 aa, Homo sapiens
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNWFNVTGSDKCVFLKNTEVSSMECEKNLYWICNKPYK

SEQ ID NO: 4 - DNA, 600 bp, Homo sapiens
atgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataa

SEQ ID NO: 5 - protein, 77 aa, Homo sapiens
LQCYNCPNPTADCKTAVNCSSDFDACLITKAGLQVYNKCWKFEHCNFNDVTTRLRENELTYYCCKKDLCNFNEQLEN

SEQ ID NO: 6 - DNA, 387 bp, Homo sapiens
atgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaa

SEQ ID NO: 7 - protein, 311 aa, Homo sapiens
QSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILRQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPAESARNLEYVSVSPTNNTVYASVTHSNRETEIWTPRENDTITIYSTINHSKESKPTFSRATALDNVV

SEQ ID NO: 8 - DNA, 996 bp, Homo sapiens
atgttgtggctgttccaatcgctcctgtttgtcttctgctttggcccagggaatgtagtttcacaaagcagcttaaccccattgatggtgaacgggattctgggggagtcagtaactcttcccctggagtttcctgcaggagagaaggtcaacttcatcacttggcttttcaatgaaacatctcttgccttcatagtaccccatgaaaccaaaagtccagaaatccacgtgactaatccgaaacagggaaagcgactgaacttcacccagtcctactccctgcaactcagcaacctgaagatggaagacacaggctcttacagagcccagatatccacaaagacctctgcaaagctgtccagttacactctgaggatattaagacaactgaggaacatacaagttaccaatcacagtcagctatttcagaatatgacctgtgagctccatctgacttgctctgtggaggatgcagatgacaatgtctcattcagatgggaggccttgggaaacacactttcaagtcagccaaacctcactgtctcctgggaccccaggatttccagtgaacaggactacacctgcatagcagagaatgctgtcagtaatttatccttctctgtctctgcccagaagctttgcgaagatgttaaaattcaatatacagataccaaaatgattctgtttatggtttctgggatatgcatagtcttcggtttcatcatactgctgttacttgttttgaggaaaagaagagattccctatctttgtctactcagcgaacacagggccccgagtccgcaaggaacctagagtatgtttcagtgtctccaacgaacaacactgtgtatgcttcagtcactcattcaaacagggaaacagaaatctggacacctagagaaaatgatactatcacaatttactccacaattaatcattccaaagagagtaaacccactttttccagggcaactgcccttgacaatgtcgtgtaa

SEQ ID NO: 9 - protein, 231 aa, Homo sapiens
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 10 - DNA, 546 bp, Homo sapiens
atgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattag

SEQ ID NO: 11 - protein, 318 aa, Homo sapiens
EEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 12 - DNA, 1011 bp, Homo sapiens
atggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaa

SEQ ID NO: 13 - protein, 347 aa, Homo sapiens
GKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 14 - DNA, 1098 bp, Homo sapiens
atgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctag

SEQ ID NO: 15 - protein, 183 aa, Homo sapiens
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 16 - DNA, 573 bp, Homo sapiens
atggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctag

SEQ ID NO: 17 - protein, 255 aa, Homo sapiens
QSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSQPQNSTLRPGPAAPIALVPVFCGLLVAKSLVLSALLVWWGDIWWKTMMELRSLDTQKATCHLQQVTDLPWTSVSSPVEREILYHTVARTKISDDDDEHTL

SEQ ID NO: 18 - DNA, 777 bp, Homo sapiens
atggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagacctcctggactccccgcgacctggtctcttcacagacccagacccagagctgtgtgcctcccactgcaggagccagacaagcccctgagtctccatctaccatccctgtcccttcacagccacagaactccacgctccgccctggccctgcagcccccattgccctggtgcctgtgttctgtggactcctcgtagccaagagcctggtgctgtcagccctgctcgtctggtgggttttaaggaatcggcacatgcagcatcaagggaggtctctgctgcacccagctcagcccaggccccaggcccatagacacttcccactgagccacagggcaccaggggggacatatggtggaaaaccatga

SEQ ID NO: 19 - protein, 283 aa, Homo sapiens
QQQTLPKPFIWAEPHFMVPKEKQVTICCQGNYGAVEYQLHFEGSLFAVDRPKPPERINKVQFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 20 - DNA, 777 bp, Homo sapiens; identical to SEQ ID NO: 18

SEQ ID NO: 21 - protein, 216 aa, Homo sapiens
MGWIRGRRSRHSWEMSEFHNYNLDLKKSDFSTRWQKQRCPVVKSKCRENASPFFFCCFIAVAMGIRFIIMVAIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 22 - DNA, 651 bp, Homo sapiens
atggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaa

SEQ ID NO: 23 - protein, 359 aa, Homo sapiens
MAEGTLWQILCVSSDAQPQTFEGVKGADPPTLPPGSFLPGPVLWWGSLARLQTEKSDEVSRKGNWWVTEMGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 24 - DNA, 1080 bp, Homo sapiens
atggctgagggcacactctggcagattctgtgtgtgtcctcagatgctcagccacagacctttgagggagtaaagggggcagacccacccaccttgcctccaggctctttccttcctggtcctgttctatggtggggctcccttgccagacttcagactgagaagtcagatgaagtttcaagaaaaggaaattggtgggtgacagagatgggtggaggggctggggaaaggctgtttacttcctcctgtctagtcggtttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatga

SEQ ID NO: 25 - protein, 233 aa, Homo sapiens
MWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 26 - DNA, 702 bp, Homo sapiens
atgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttga

SEQ ID NO: 27 - protein, 304 aa, Homo sapiens [sequence omitted]

SEQ ID NO: 28 - DNA, 915 bp, Homo sapiens
atgtcgctcacggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataa

SEQ ID NO: 29 - protein, 304 aa, Homo sapiens [sequence omitted]

SEQ ID NO: 30 - DNA, 1026 bp, Homo sapiens
atgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccaga

SEQ ID NO: 31 - protein, 304 aa, Homo sapiens
MSLMVISMACVGFFWLQGAWPHEGFRRKPSLLAHPGRLVKSEETVILQCWSDVMFEHFLLHREGTFNDTLRLIGEHIDGVSKANFSIGRMRQDLAGTYRCYGSVPHSPYQFSAPSDPLDIVITGLYEKPSLSAQPGPTVLAGESVTLSCSSWSSYDMYHLSTEGEAHERRFSAGPKVNGTFQADFPLGPATQGGTYRCFGSFHDSPYEWSKSSDPLLVSVTGNPSNSWPSPTEPSSKTGNPRHLHVLIGTSVVKLPFTILLFFLLHRWCSDKKNASVMDQGPAGNRTVNREDSDEQDHQEVSYA

SEQ ID NO: 32 - DNA, 915 bp, Homo sapiens
atgtcgctcatggtcatcagcatggcatgtgttgggttcttctggctgcagggggcctggccacatgagggattccgcagaaaaccttccctcctggcccacccaggtcgcctggtgaaatcagaagagacagtcatcctgcaatgttggtcagatgtcatgtttgagcacttccttctgcacagagaggggacgtttaacgacactttgcgcctcattggagagcacattgatggggtctccaaggccaacttctccatcggtcgcatgaggcaagacctggcagggacctacagatgctacggttctgttcctcactccccctatcagttttcagctcccagtgaccctctggacatcgtgatcacaggtctatatgagaaaccttctctctcagcccagccgggccccacggttctggcaggagagagcgtgaccttgtcctgcagctcctggagctcctatgacatgtaccatctatccacggagggggaggcccatgaacgtaggttctctgcagggcccaaggtcaacggaacattccaggccgactttcctctgggccctgccacccaaggaggaacctacagatgcttcggctctttccatgactctccctacgagtggtcaaagtcaagtgacccactgcttgtttctgtcacaggaaacccttcaaatagttggccttcacccactgaaccaagctccaaaaccggtaaccccagacacctacacgttctgattgggacctcagtggtcaaactccctttcaccatcctcctcttctttctccttcatcgctggtgctccgacaaaaaaaatgcatctgtaatggaccaagggcctgcggggaacagaacagtgaacagggaggattctgatgaacaggaccatcaggaggtgtcatacgcataa

SEQ ID NO: 33 - protein, 354 aa, Homo sapiens
HVGGQDKPFCSAWPSAVVPQGGHATLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 34 - DNA, 1251 bp, Homo sapiens
atgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctga

SEQ ID NO: 35 - protein, 218 aa, Homo sapiens
QEGVHRKPSFLALPGHLVKSEETVILQCWSDVMFEHFLLHREGKFNNTLHLIGEHHDGVSKANFSIGPMMPVLAGTYRCYSSVPHSPYQLSAPSDPLDMVIIGLYEKPSLSAQPGPTVQAGENVSLSCSSIYPGRGRPMNVGSLQCAASTEHSRPTFLWALPPTEGPTDASALSVTLPTSGQTRVIHCLFPSQETLQIVGLHPLNQAPKPVTPDTYMF

SEQ ID NO: 36 - DNA, 893 bp, Homo sapiens
atgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataa

SEQ ID NO: 37 - protein, 283 aa, Homo sapiens
HEGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLSCSSRSSYDMYHLSREGEAHERRLPAGTKVNGTFQADFPLDPATHGGTYRCFGSFRDSPYEWSKSSDPLLVSVTGNTSNSWPSPTEPSSKTGNPRHLHVLIGTSVVKLPFTILLFFLLHRWCSNKKNASVMDQGPAGNRTVNREDSDEQDHQEVSYA

SEQ ID NO: 38 - DNA, 915 bp, Homo sapiens
atgtcgctcatggtcatcagcatggcgtgtgttgcgttcttcttgctgcagggggcctggccacatgagggattccgcagaaaaccttccctcctggcccacccaggtcccctggtgaaatcagaagagacagtcatcctgcaatgttggtcagatgtcatgtttgagcacttccttctgcacagagaggggacgtttaaccacactttgcgcctcattggagagcacattgatggggtctccaagggcaacttctccatcggtcgcatgacacaagacctggcagggacctacagatgctacggttctgttactcactccccctatcagttgtcagcgcccagtgaccctctggacatcgtgatcacaggtctatatgagaaaccttctctctcagcccagccgggccccacggttctggcaggagagagcgtgaccttgtcctgcagctcccggagctcctatgacatgtaccatctatccagggaaggggaggcccatgaacgtaggctccctgcagggcccaaggtcaacagaacattccaggccgactttcctctggaccctgccacccacggagggacctacagatgcttcggctctttccgtgactctccatacgagtggtcaaagtcaagtgacccactgcttgtttctgtcacaggaaactcttcaaatagttggccttcacccactgaaccaagctccgaaaccggtaaccccagacacctacacgttctgattgggacctcagtggtcaaactccctttcaccatcctcctcttctttctccttcatcgctggtgctccaacaaaaaaaatgcatctgtaatggaccaagggcctgcggggaacagaacagtgaacagggaggattctgatgaacaggaccatcaggaggtgtcatacgcataa

SEQ ID NO: 39 - protein, 361 aa, Homo sapiens
HMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHKEGISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKKCCCNGPRACREQK

SEQ ID NO: 40 - DNA, 1149 bp, Homo sapiens
atgttgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtga

SEQ ID NO: 41 - protein, 231 aa, Homo sapiens
MSKQRGTFSEVSLAQDPKRQQRKPKGNKSSISGTEQEIFQVELNLQNPSLNHQGIDKIYDCQGLLPPPEKLTAEVLGIICIVLMATVLKTIVLIPFLEQNNSSPNTRTQKARHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKL

SEQ ID NO: 42 - DNA, 696 bp, Homo sapiens
atgaataaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaatttttccccgaatacaagaacgcagaaagcacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttag

SEQ ID NO: 43 - protein, 354 aa, Homo sapiens
QDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 44 - DNA, 1137 bp, Homo sapiens
atggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccatag

SEQ ID NO: 45 - protein, 368 aa, Homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 46 - DNA, 1248 bp, Homo sapiens
atggagttgaggaagtacggccctggaagactggcggggacagttataggaggagctgctcagagtaaatcacagactaaatcagactcaatcacaaaagagttcctgccaggcctttacacagccccttcctccccgttcccgccctcacaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtga

SEQ ID NO: 47 - protein, 344 aa, Homo sapiens
DFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYNPLFIPVAVMVTAFSGLAFIIWLARRLKKGKKSKRSMNDPY

SEQ ID NO: 48 - DNA, 1158 bp, Homo sapiens
atgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaa

SEQ ID NO: 49 - protein, 350 aa, Homo sapiens
  MOD_RES (31)..(31): Any amino acid
MSNITDPQMWDFDDLNFTGMPPADEDYSPCXLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 50 - DNA, 1053 bp, Homo sapiens
atgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctga

SEQ ID NO: 51 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 52 - DNA, 1083 bp, Homo sapiens
atggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctctgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaa

SEQ ID NO: 53 - protein, 355 aa, Homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 54 - DNA, 1068 bp, Homo sapiens
atggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctga

SEQ ID NO: 55 - protein, 373 aa, Homo sapiens
MRMEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLQRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 56 - DNA, 1122 bp, Homo sapiens
atgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttga

SEQ ID NO: 57 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 58 - DNA, 1071 bp, Homo sapiens
atgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaa

SEQ ID NO: 59 - protein, 352 aa, Homo sapiens [sequence omitted]

SEQ ID NO: 60 - DNA, 1059 bp, Homo sapiens
atggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtga

SEQ ID NO: 61 - protein, 398 aa, Homo sapiens
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 62 - DNA, 1197 bp, Homo sapiens
atggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactga

SEQ ID NO: 63 - protein, 951 aa, Homo sapiens
QPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNTKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKGNNKEQIHPHTLFTPLLIGFVIVAGMMCIIVMILTYKYLQKPMYEVQWKVVEEINGNNYVYIDPTQLPYDHKWEFPRNRLSFGKTLGAGAFGKVVEATAYGLIKSDAAMTVAVKMLKPSAHLTEREALMSELKVLSYLGNHMNIVNLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 64 - DNA, 2931 bp, Homo sapiens
atgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctga

SEQ ID NO: 65 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 66 - DNA, 7650 bp, Homo sapiens
atgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaa

SEQ ID NO: 67 - protein, 1147 aa, Homo sapiens
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 68 - DNA, 3444 bp, Homo sapiens
atggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctag

SEQ ID NO: 69 - protein, 138 aa, Homo sapiens
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 70 - DNA, 414 bp, Homo sapiens
caggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggt

SEQ ID NO: 71 - protein, 227 aa, Homo sapiens
IIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 72 - DNA, 681 bp, Homo sapiens
atcatcgggggacatgaggccaagccccactcccgcccctacatggcttatcttatgatctgggatcagaagtctctgaagaggtgcggtggcttcctgatacgagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctac

SEQ ID NO: 73 - protein, 268 aa, Homo sapiens
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 74 - protein, 272 aa, Homo sapiens
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 75 - protein, 223 aa, Homo sapiens [sequence omitted]

SEQ ID NO: 76 - protein, 311 aa, Homo sapiens
NADGLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 77 - protein, 279 aa, Homo sapiens
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAM

SEQ ID NO: 78 - protein, 133 aa, Homo sapiens [sequence omitted]

SEQ ID NO: 79 - protein, 152 aa, Homo sapiens
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 80 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 81 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 82 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 83 - protein, 133 aa, Homo sapiens [sequence omitted]

SEQ ID NO: 84 - protein, 270 aa, Homo sapiens
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 85 - protein, 696 aa, Artificial Sequence
  source: /note="Description of Artificial Sequence: Synthetic polypeptide"
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREVQLQQSGPELVKPGASVKMSCKASGYTFTSYVIQWVKQKPGQGLEWIGSINPYNDYTKYNEKFKGKATLTSDKSSITAYMEFSSLTSEDSALYYCARWGDGNYWGRGTTLTVSSGGGGSGGGGSGGGGSDIEMTQSPAIMSASLGERVTMTCTASSSVSSSYFHWYQQKPGSSPKLCIYSTSNLASGVPPRFSGSGSTSYSLTISSMEAEDAATYFCHQYHRSPTFGGGTKLETKR

SEQ ID NO: 86 - DNA, 2088 bp, Artificial Sequence
  source: /note="Description of Artificial Sequence: Synthetic polynucleotide"
cagatcgtgctgacccaaagccccgccatcatgagcgctagccccggtgagaaggtgaccatgacatgctccgcttccagctccgtgtcctacatgaactggtatcagcagaaaagcggaaccagccccaaaaggtggatctacgacaccagcaagctggcctccggagtgcccgctcatttccggggctctggatccggcaccagctactctttaaccatttccggcatggaagctgaagacgctgccacctactattgccagcaatggagcagcaaccccttcacattcggatctggcaccaagctcgaaatcaatcgtggaggaggtggcagcggcggcggtggatccggcggaggaggaagccaagttcaactccagcagagcggcgctgaactggcccggcccggcgcctccgtcaagatgagctgcaaggcttccggctatacatttactcgttacacaatgcattgggtcaagcagaggcccggtcaaggtttagagtggatcggatatatcaacccttcccggggctacaccaactataaccaaaagttcaaggataaagccactttaaccactgacaagagctcctccaccgcctacatgcagctgtcctctttaaccagcgaggactccgctgtttactactgcgctaggtattacgacgaccactactgtttagactattggggacaaggtaccactttaaccgtcagcagctccggcaccaccaataccgtggccgcttataacctcacatggaagagcaccaacttcaagacaattctggaatgggaacccaagcccgtcaatcaagtttacaccgtgcagatctccaccaaatccggagactggaagagcaagtgcttctacacaacagacaccgagtgtgatttaaccgacgaaatcgtcaaggacgtcaagcaaacctatctggctcgggtcttttcctaccccgctggcaatgtcgagtccaccggctccgctggcgagcctctctacgagaattcccccgaattcaccccttatttagagaccaatttaggccagcctaccatccagagcttcgagcaagttggcaccaaggtgaacgtcaccgtcgaggatgaaaggactttagtgcggcggaataacacatttttatccctccgggatgtgttcggcaaagacctcatctacacactgtactattggaagtccagctcctccggcaaaaagaccgctaagaccaacaccaacgagtttttaattgacgtggacaaaggcgagaactactgcttcagcgtgcaagccgtgatcccttctcgtaccgtcaaccggaagagcacagattcccccgttgagtgcatgggccaagaaaagggcgagttccgggaggtccagctgcagcagagcggacccgaactcgtgaaacccggtgcttccgtgaaaatgtcttgtaaggccagcggatacaccttcacctcctatgtgatccagtgggtcaaacagaagcccggacaaggtctcgagtggatcggcagcatcaacccttacaacgactataccaaatacaacgagaagtttaagggaaaggctactttaacctccgacaaaagctccatcacagcctacatggagttcagctctttaacatccgaggacagcgctctgtactattgcgcccggtggggcgacggcaattactggggacggggcacaacactgaccgtgagcagcggaggcggaggctccggcggaggcggatctggcggtggcggctccgacatcgagatgacccagtcccccgctatcatgtccgcctctttaggcgagcgggtcacaatgacttgtacagcctcctccagcgtctcctcctcctacttccattggtaccaacagaaacccggaagctcccctaaactgtgcatctacagcaccagcaatctcgccagcggcgtgccccctaggttttccggaagcggaagcaccagctactctttaaccatctcctccatggaggctgaggatgccgccacctacttttgtcaccagtaccaccggtcccccaccttcggaggcggcaccaaactggagacaaagagg

SEQ ID NO: 87 - protein, 714 aa, Artificial Sequence
  source: /note="Description of Artificial Sequence: Synthetic polypeptide"
MKWVTFISLLFLFSSAYSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREVQLQQSGPELVKPGASVKMSCKASGYTFTSYVIQWVKQKPGQGLEWIGSINPYNDYTKYNEKFKGKATLTSDKSSITAYMEFSSLTSEDSALYYCARWGDGNYWGRGTTLTVSSGGGGSGGGGSGGGGSDIEMTQSPAIMSASLGERVTMTCTASSSVSSSYFHWYQQKPGSSPKLCIYSTSNLASGVPPRFSGSGSTSYSLTISSMEAEDAATYFCHQYHRSPTFGGGTKLETKR

SEQ ID NO: 88 - DNA, 2142 bp, Artificial Sequence
  source: /note="Description of Artificial Sequence: Synthetic polynucleotide"
atgaagtgggtgaccttcatcagcttattatttttattcagctccgcctattcccagatcgtgctgacccaaagccccgccatcatgagcgctagccccggtgagaaggtgaccatgacatgctccgcttccagctccgtgtcctacatgaactggtatcagcagaaaagcggaaccagccccaaaaggtggatctacgacaccagcaagctggcctccggagtgcccgctcatttccggggctctggatccggcaccagctactctttaaccatttccggcatggaagctgaagacgctgccacctactattgccagcaatggagcagcaaccccttcacattcggatctggcaccaagctcgaaatcaatcgtggaggaggtggcagcggcggcggtggatccggcggaggaggaagccaagttcaactccagcagagcggcgctgaactggcccggcccggcgcctccgtcaagatgagctgcaaggcttccggctatacatttactcgttacacaatgcattgggtcaagcagaggcccggtcaaggtttagagtggatcggatatatcaacccttcccggggctacaccaactataaccaaaagttcaaggataaagccactttaaccactgacaagagctcctccaccgcctacatgcagctgtcctctttaaccagcgaggactccgctgtttactactgcgctaggtattacgacgaccactactgtttagactattggggacaaggtaccactttaaccgtcagcagctccggcaccaccaataccgtggccgcttataacctcacatggaagagcaccaacttcaagacaattctggaatgggaacccaagcccgtcaatcaagtttacaccgtgcagatctccaccaaatccggagactggaagagcaagtgcttctacacaacagacaccgagtgtgatttaaccgacgaaatcgtcaaggacgtcaagcaaacctatctggctcgggtcttttcctaccccgctggcaatgtcgagtccaccggctccgctggcgagcctctctacgagaattcccccgaattcaccccttatttagagaccaatttaggccagcctaccatccagagcttcgagcaagttggcaccaaggtgaacgtcaccgtcgaggatgaaaggactttagtgcggcggaataacacatttttatccctccgggatgtgttcggcaaagacctcatctacacactgtactattggaagtccagctcctccggcaaaaagaccgctaagaccaacaccaacgagtttttaattgacgtggacaaaggcgagaactactgcttcagcgtgcaagccgtgatcccttctcgtaccgtcaaccggaagagcacagattcccccgttgagtgcatgggccaagaaaagggcgagttccgggaggtccagctgcagcagagcggacccgaactcgtgaaacccggtgcttccgtgaaaatgtcttgtaaggccagcggatacaccttcacctcctatgtgatccagtgggtcaaacagaagcccggacaaggtctcgagtggatcggcagcatcaacccttacaacgactataccaaatacaacgagaagtttaagggaaaggctactttaacctccgacaaaagctccatcacagcctacatggagttcagctctttaacatccgaggacagcgctctgtactattgcgcccggtggggcgacggcaattactggggacggggcacaacactgaccgtgagcagcggaggcggaggctccggcggaggcggatctggcggtggcggctccgacatcgagatgacccagtcccccgctatcatgtccgcctctttaggcgagcgggtcacaatgacttgtacagcctcctccagcgtctcctcctcctacttccattggtaccaacagaaacccggaagctcccctaaactgtgcatctacagcaccagcaatctcgccagcggcgtgccccctaggttttccggaagcggaagcaccagctactctttaaccatctcctccatggaggctgaggatgccgccacctacttttgtcaccagtaccaccggtcccccaccttcggaggcggcaccaaactggagacaaagagg

SEQ ID NO: 89 - protein, 696 aa, Artificial Sequence
  source: /note="Description of Artificial Sequence: Synthetic polypeptide"
VQLQQSGPELVKPGASVKMSCKASGYTFTSYVIQWVKQKPGQGLEWIGSINPYNDYTKYNEKFKGKATLTSDKSSITAYMEFSSLTSEDSALYYCARWGDGNYWGRGTTLTVSSGGGGSGGGGSGGGGSDIEMTQSPAIMSASLGERVTMTCTASSSVSSSYFHWYQQKPGSSPKLCIYSTSNLASGVPPRFSGSGSTSYSLTISSMEAEDAATYFCHQYHRSPTFGGGTKLETKRSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 90 - DNA, 2088 bp, Artificial Sequence
  source: /note="Description of Artificial Sequence: Synthetic polynucleotide"
gtgcagctgcagcagtccggacccgaactggtcaagcccggtgcctccgtgaaaatgtcttgtaaggcttctggctacacctttacctcctacgtcatccaatgggtgaagcagaagcccggtcaaggtctcgagtggatcggcagcatcaatccctacaacgattacaccaagtataacgaaaagtttaagggcaaggccactctgacaagcgacaagagctccattaccgcctacatggagttttcctctttaacttctgaggactccgctttatactattgcgctcgttggggcgatggcaattattggggccggggaactactttaacagtgagctccggcggcggcggaagcggaggtggaggatctggcggtggaggcagcgacatcgagatgacacagtcccccgctatcatgagcgcctctttaggagaacgtgtgaccatgacttgtacagcttcctccagcgtgagcagctcctatttccactggtaccagcagaaacccggctcctcccctaaactgtgtatctactccacaagcaatttagctagcggcgtgcctcctcgttttagcggctccggcagcacctcttactctttaaccattagctctatggaggccgaagatgccgccacatacttttgccatcagtaccaccggtcccctacctttggcggaggcacaaagctggagaccaagcggagcggcaccaccaacacagtggccgcctacaatctgacttggaaatccaccaacttcaagaccatcctcgagtgggagcccaagcccgttaatcaagtttataccgtgcagatttccaccaagagcggcgactggaaatccaagtgcttctataccacagacaccgagtgcgatctcaccgacgagatcgtcaaagacgtgaagcagacatatttagctagggtgttctcctaccccgctggaaacgtggagagcaccggatccgctggagagcctttatacgagaactcccccgaattcaccccctatctggaaaccaatttaggccagcccaccatccagagcttcgaacaagttggcacaaaggtgaacgtcaccgtcgaagatgagaggactttagtgcggaggaacaatacatttttatccttacgtgacgtcttcggcaaggatttaatctacacactgtattactggaagtctagctcctccggcaagaagaccgccaagaccaataccaacgaatttttaattgacgtggacaagggcgagaactactgcttctccgtgcaagctgtgatcccctcccggacagtgaaccggaagtccaccgactcccccgtggagtgcatgggccaagagaagggagagtttcgtgagcagatcgtgctgacccagtcccccgctattatgagcgctagccccggtgaaaaggtgactatgacatgcagcgccagctcttccgtgagctacatgaactggtatcagcagaagtccggcaccagccctaaaaggtggatctacgacaccagcaagctggccagcggcgtccccgctcactttcggggctccggctccggaacaagctactctctgaccatcagcggcatggaagccgaggatgccgctacctattactgtcagcagtggagctccaaccccttcacctttggatccggcaccaagctcgagattaatcgtggaggcggaggtagcggaggaggcggatccggcggtggaggtagccaagttcagctccagcaaagcggcgccgaactcgctcggcccggcgcttccgtgaagatgtcttgtaaggcctccggctataccttcacccggtacacaatgcactgggtcaagcaacggcccggtcaaggtttagagtggattggctatatcaacccctcccggggctataccaactacaaccagaagttcaaggacaaagccaccctcaccaccgacaagtccagcagcaccgcttacatgcagctgagctctttaacatccgaggattccgccgtgtactactgcgctcggtactacgacgatcattactgcctcgattactggggccaaggtaccaccttaacagtctcctcc

SEQ ID NO: 91 - protein, 714 aa, Artificial Sequence
  source: /note="Description of Artificial Sequence: Synthetic polypeptide"
MKWVTFISLLFLFSSAYSVQLQQSGPELVKPGASVKMSCKASGYTFTSYVIQWVKQKPGQGLEWIGSINPYNDYTKYNEKFKGKATLTSDKSSITAYMEFSSLTSEDSALYYCARWGDGNYWGRGTTLTVSSGGGGSGGGGSGGGGSDIEMTQSPAIMSASLGERVTMTCTASSSVSSSYFHWYQQKPGSSPKLCIYSTSNLASGVPPRFSGSGSTSYSLTISSMEAEDAATYFCHQYHRSPTFGGGTKLETKRSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 92 - DNA, 2142 bp, Artificial Sequence
  source: /note="Description of Artificial Sequence: Synthetic polynucleotide"
atgaaatgggtcaccttcatctctttactgtttttatttagcagcgcctacagcgtgcagctgcagcagtccggacccgaactggtcaagcccggtgcctccgtgaaaatgtcttgtaaggcttctggctacacctttacctcctacgtcatccaatgggtgaagcagaagcccggtcaaggtctcgagtggatcggcagcatcaatccctacaacgattacaccaagtataacgaaaagtttaagggcaaggccactctgacaagcgacaagagctccattaccgcctacatggagttttcctctttaacttctgaggactccgctttatactattgcgctcgttggggcgatggcaattattggggccggggaactactttaacagtgagctccggcggcggcggaagcggaggtggaggatctggcggtggaggcagcgacatcgagatgacacagtcccccgctatcatgagcgcctctttaggagaacgtgtgaccatgacttgtacagcttcctccagcgtgagcagctcctatttccactggtaccagcagaaacccggctcctcccctaaactgtgtatctactccacaagcaatttagctagcggcgtgcctcctcgttttagcggctccggcagcacctcttactctttaaccattagctctatggaggccgaagatgccgccacatacttttgccatcagtaccaccggtcccctacctttggcggaggcacaaagctggagaccaagcggagcggcaccaccaacacagtggccgcctacaatctgacttggaaatccaccaacttcaagaccatcctcgagtgggagcccaagcccgttaatcaagtttataccgtgcagatttccaccaagagcggcgactggaaatccaagtgcttctataccacagacaccgagtgcgatctcaccgacgagatcgtcaaagacgtgaagcagacatatttagctagggtgttctcctaccccgctggaaacgtggagagcaccggatccgctggagagcctttatacgagaactcccccgaattcaccccctatctggaaaccaatttaggccagcccaccatccagagcttcgaacaagttggcacaaaggtgaacgtcaccgtcgaagatgagaggactttagtgcggaggaacaatacatttttatccttacgtgacgtcttcggcaaggatttaatctacacactgtattactggaagtctagctcctccggcaagaagaccgccaagaccaataccaacgaatttttaattgacgtggacaagggcgagaactactgcttctccgtgcaagctgtgatcccctcccggacagtgaaccggaagtccaccgactcccccgtggagtgcatgggccaagagaagggagagtttcgtgagcagatcgtgctgacccagtcccccgctattatgagcgctagccccggtgaaaaggtgactatgacatgcagcgccagctcttccgtgagctacatgaactggtatcagcagaagtccggcaccagccctaaaaggtggatctacgacaccagcaagctggccagcggcgtccccgctcactttcggggctccggctccggaacaagctactctctgaccatcagcggcatggaagccgaggatgccgctacctattactgtcagcagtggagctccaaccccttcacctttggatccggcaccaagctcgagattaatcgtggaggcggaggtagcggaggaggcggatccggcggtggaggtagccaagttcagctccagcaaagcggcgccgaactcgctcggcccggcgcttccgtgaagatgtcttgtaaggcctccggctataccttcacccggtacacaatgcactgggtcaagcaacggcccggtcaaggtttagagtggattggctatatcaacccctcccggggctataccaactacaaccagaagttcaaggacaaagccaccctcaccaccgacaagtccagcagcaccgcttacatgcagctgagctctttaacatccgaggattccgccgtgtactactgcgctcggtactacgacgatcattactgcctcgattactggggccaaggtaccaccttaacagtctcctcc

SEQ ID NO: 93 - protein, 219 aa, Homo sapiens
SGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRE

SEQ ID NO: 94 - DNA, 657 bp, Homo sapiens
agcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggag

SEQ ID NO: 95 - protein, 223 aa, Mus sp.
AGIPEKAFNLTWISTDFKTILEWQPKPTNYTYTVQISDRSRNWKNKCFSTTDTECDLTDEIVKDVTWAYEAKVLSVPRRNSVHGDGDQLVIHGEEPPFTNAPKFLPYRDTNLGQPVIQQFEQDGRKLNVVVKDSLTLVRKNGTFLTLRQVFGKDLGYIITYRKGSSTGKKTNITNTNEFSIDVEEGVSYCFFVQAMIFSRKTNQNSPGSSTVCTEQWKSFLGE

SEQ ID NO: 96 - protein, 224 aa, Rattus sp.
AGTPPGKAFNLTWISTDFKTILEWQPKPTNYTYTVQISDRSRNWKYKCTGTTDTECDLTDEIVKDVNWTYEARVLSVPWRNSTHGKETLFGTHGEEPPFTNARKFLPYRDTKIGQPVIQKYEQGGTKLKVTVKDSFTLVRKNGTFLTLRQVFGNDLGYILTYRKDSSTGRKTNTTHTNEFLIDVEKGVSYCFFAQAVIFSRKTNHKSPESITKCTEQWKSVLGE

SEQ ID NO: 97 - protein, 219 aa, Artificial Sequence
  source: /note="Description of Artificial Sequence: Synthetic polypeptide"
SGTTNTVAAYNLTWKSTNFATALEWEPKPVNQVYTVQISTKSGDWKSKCFYTTDTECALTDEIVKDVKQTYLARVFSYPAGNVESTGSAGEPLYENSPEFTPYLETNLGQPTIQSFEQVGTKVNVTVEDERTLVARNNTALSLRDVFGKDLIYTLYYWKSSSSGKKTAKTNTNEFLIDVDKGENYCFSVQAVIPSRTVNRKSTDSPVECMGQEKGEFRE

SEQ ID NO: 98 - protein, 219 aa, Artificial Sequence
  source: /note="Description of Artificial Sequence: Synthetic polypeptide"
SGTTNTVAAYNLTWKSTNFATALEWEPKPVNQVYTVQISTKSGDAKSKCFYTTDTECALTDEIVKDVKQTYLARVFSYPAGNVESTGSAGEPLAENSPEFTPYLETNLGQPTIQSFEQVGTKVNVTVEDERTLVARNNTALSLRDVFGKDLIYTLYYWKSSSSGKKTAKTNTNEFLIDVDKGENYCFSVQAVIPSRTVNRKSTDSPVECMGQEKGEFRE

SEQ ID NO: 99 - protein, 4 aa, Artificial Sequence
  source: /note="Description of Artificial Sequence: Synthetic peptide"
GGGS

SEQ ID NO: 100 - protein, 5 aa, Artificial Sequence
  source: /note="Description of Artificial Sequence: Synthetic peptide"
GGGGS

SEQ ID NO: 101 - protein, 4 aa, Artificial Sequence
  source: /note="Description of Artificial Sequence: Synthetic peptide"
GGSG

SEQ ID NO: 102 - protein, 15 aa, Artificial Sequence
  source: /note="Description of Artificial Sequence: Synthetic peptide"
GGGGSGGGGSGGGGS

SEQ ID NO: 103 - DNA, 45 bp, Artificial Sequence
  source: /note="Description of Artificial Sequence: Synthetic oligonucleotide"
ggcggtggaggatccggaggaggtggctccggcggcggaggatct

SEQ ID NO: 104 - protein, 8 aa, Artificial Sequence
  source: /note="Description of Artificial Sequence: Synthetic peptide"
GGGSGGGS

SEQ ID NO: 105 - protein, 133 aa, Homo sapiens
APMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 106 - protein, 79 aa, Homo sapiens
EGAVLPRSAKELRCQCIKTYSKPFHPKFIKELRVIESGPHCANTEIIVKLSDGRELCLDPKENWVQRVVEKFLKRAENS

SEQ ID NO: 107 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 108 - protein, 132 aa, Homo sapiens
GITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 109 - protein, 157 aa, Homo sapiens
YFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 110 - protein, 352 aa, Homo sapiens
RDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 111 - protein, 248 aa, Homo sapiens
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 112 - protein, 209 aa, Homo sapiens
TQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 113 - protein, 65 aa, Artificial Sequence
  source: /note="Description of Artificial Sequence: Synthetic polypeptide"
ITCPPPMSVEHADIWVKSYSLYSRERYICNSGFKRKAGTSSLTECVLNKATNVAHWTTPSLKCIR

SEQ ID NO: 114 - DNA, 195 bp, Artificial Sequence
  source: /note="Description of Artificial Sequence: Synthetic polynucleotide"
attacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccgg

SEQ ID NO: 115 - protein, 114 aa, Artificial Sequence; identical to SEQ ID NO: 82
  source: /note="Description of Artificial Sequence: Synthetic polypeptide"

SEQ ID NO: 116 - DNA, 342 bp, Artificial Sequence
  source: /note="Description of Artificial Sequence: Synthetic polynucleotide"
aactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 117 - protein, 18 aa, Artificial Sequence
  source: /note="Description of Artificial Sequence: Synthetic peptide"
MKWVTFISLLFLFSSAYS

SEQ ID NO: 118 - DNA, 54 bp, Artificial Sequence
  source: /note="Description of Artificial Sequence: Synthetic oligonucleotide"
atgaaatgggtgacctttatttctttactgttcctctttagcagcgcctactcc

SEQ ID NO: 119 - DNA, 54 bp, Artificial Sequence
  source: /note="Description of Artificial Sequence: Synthetic oligonucleotide"
atgaagtgggtcacatttatctctttactgttcctcttctccagcgcctacagc

SEQ ID NO: 120 - DNA, 54 bp, Artificial Sequence; identical to SEQ ID NO: 118
  source: /note="Description of Artificial Sequence: Synthetic oligonucleotide"

SEQ ID NO: 121 - protein, 16 aa, Artificial Sequence
  source: /note="Description of Artificial Sequence: Synthetic peptide"
MKCLLYLAFLFLGVNC

SEQ ID NO: 122 - protein, 58 aa, Artificial Sequence
  source: /note="Description of Artificial Sequence: Synthetic polypeptide"
MGQIVTMFEALPHIIDEVINIVIIVLIIITSIKAVYNFATCGILALVSFLFLAGRSCG

SEQ ID NO: 123 - protein, 97 aa, Artificial Sequence
  source: /note="Description of Artificial Sequence: Synthetic polypeptide"
MPNHQSGSPTGSSDLLLSGKKQRPHLALRRKRRREMRKINRKVRRMNLAPIKEKTAWQHLQALISEAEEVLKTSQTPQNSLTLFLALLSVLGPPVTG

SEQ ID NO: 124 - protein, 30 aa, Artificial Sequence
  source: /note="Description of Artificial Sequence: Synthetic polypeptide"
MDSKGSSQKGSRLLLLLVVSNLLLCQGVVS

SEQ ID NO: 125 - protein, 16 aa, Artificial Sequence
  source: /note="Description of Artificial Sequence: Synthetic peptide"
MKCLLYLAFLFLGVNC

SEQ ID NO: 126 - protein, 15 aa, Artificial Sequence
  source: /note="Description of Artificial Sequence: Synthetic peptide"
GLNDIFEAQKIEWHE

SEQ ID NO: 127 - protein, 26 aa, Artificial Sequence
  source: /note="Description of Artificial Sequence: Synthetic peptide"
KRRWKKNFIAVSAANRFKKISSSGAL

SEQ ID NO: 128 - protein, 6 aa, Artificial Sequence
  source: /note="Description of Artificial Sequence: Synthetic peptide"
EEEEEE

SEQ ID NO: 129 - protein, 13 aa, Artificial Sequence
  source: /note="Description of Artificial Sequence: Synthetic peptide"
GAPVPYPDPLEPR

SEQ ID NO: 130 - protein, 8 aa, Artificial Sequence
  source: /note="Description of Artificial Sequence: Synthetic peptide"
DYKDDDDK

SEQ ID NO: 131 - protein, 9 aa, Artificial Sequence
  source: /note="Description of Artificial Sequence: Synthetic peptide"
YPYDVPDYA

SEQ ID NO: 132 - protein, 5 aa, Artificial Sequence
  source: /note="Description of Artificial Sequence: Synthetic peptide"
HHHHH

SEQ ID NO: 133 - protein, 6 aa, Artificial Sequence
  source: /note="Description of Artificial Sequence: Synthetic peptide"
HHHHHH

SEQ ID NO: 134 - protein, 7 aa, Artificial Sequence
  source: /note="Description of Artificial Sequence: Synthetic peptide"
HHHHHHH

SEQ ID NO: 135 - protein, 8 aa, Artificial Sequence
  source: /note="Description of Artificial Sequence: Synthetic peptide"
HHHHHHHH

SEQ ID NO: 136 - protein, 9 aa, Artificial Sequence
  source: /note="Description of Artificial Sequence: Synthetic peptide"
HHHHHHHHH

SEQ ID NO: 137 - protein, 10 aa, Artificial Sequence
  source: /note="Description of Artificial Sequence: Synthetic peptide"
HHHHHHHHHH

SEQ ID NO: 138 - protein, 10 aa, Artificial Sequence
  source: /note="Description of Artificial Sequence: Synthetic peptide"
EQKLISEEDL

SEQ ID NO: 139 - protein, 18 aa, Artificial Sequence
  source: /note="Description of Artificial Sequence: Synthetic peptide"
TKENPRSNQEESYDDNES

SEQ ID NO: 140 - protein, 15 aa, Artificial Sequence
  source: /note="Description of Artificial Sequence: Synthetic peptide"
KETAAAKFERQHMDS

SEQ ID NO: 141 - protein, 38 aa, Artificial Sequence
  source: /note="Description of Artificial Sequence: Synthetic polypeptide"
MDEKTTGWRGGHVVEGLAGELEQLRARLEHHPQGQREP

SEQ ID NO: 142 - protein, 13 aa, Artificial Sequence
  source: /note="Description of Artificial Sequence: Synthetic peptide"
SLAELLNAGLGGS

SEQ ID NO: 143 - protein, 8 aa, Artificial Sequence
  source: /note="Description of Artificial Sequence: Synthetic peptide"
TQDPSRVG

SEQ ID NO: 144 - protein, 12 aa, Artificial Sequence
  source: /note="Description of Artificial Sequence: Synthetic peptide"
PDRVRAVSHWSS

SEQ ID NO: 145 - protein, 8 aa, Artificial Sequence
  source: /note="Description of Artificial Sequence: Synthetic peptide"
WSHPQFEK

SEQ ID NO: 146 - protein, 6 aa, Artificial Sequence
  source: /note="Description of Artificial Sequence: Synthetic peptide"
CCPGCC

SEQ ID NO: 147 - protein, 10 aa, Artificial Sequence
  source: /note="Description of Artificial Sequence: Synthetic peptide"
EVHTNQDPLD

SEQ ID NO: 148 - protein, 14 aa, Artificial Sequence
  source: /note="Description of Artificial Sequence: Synthetic peptide"
GKPIPNPLLGLDST

SEQ ID NO: 149 - protein, 11 aa, Artificial Sequence
  source: /note="Description of Artificial Sequence: Synthetic peptide"
YTDIEMNRLGK

SEQ ID NO: 150 - protein, 8 aa, Artificial Sequence
  source: /note="Description of Artificial Sequence: Synthetic peptide"
DLYDDDDK

SEQ ID NO: 151 - protein, 241 aa, Artificial Sequence
  source: /note="Description of Artificial Sequence: Synthetic polypeptide"
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 152 - DNA, 723 bp, Artificial Sequence
  source: /note="Description of Artificial Sequence: Synthetic polynucleotide"
cagatcgtgctgacccaaagccccgccatcatgagcgctagccccggtgagaaggtgaccatgacatgctccgcttccagctccgtgtcctacatgaactggtatcagcagaaaagcggaaccagccccaaaaggtggatctacgacaccagcaagctggcctccggagtgcccgctcatttccggggctctggatccggcaccagctactctttaaccatttccggcatggaagctgaagacgctgccacctactattgccagcaatggagcagcaaccccttcacattcggatctggcaccaagctcgaaatcaatcgtggaggaggtggcagcggcggcggtggatccggcggaggaggaagccaagttcaactccagcagagcggcgctgaactggcccggcccggcgcctccgtcaagatgagctgcaaggcttccggctatacatttactcgttacacaatgcattgggtcaagcagaggcccggtcaaggtttagagtggatcggatatatcaacccttcccggggctacaccaactataaccaaaagttcaaggataaagccactttaaccactgacaagagctcctccaccgcctacatgcagctgtcctctttaaccagcgaggactccgctgtttactactgcgctaggtattacgacgaccactactgtttagactattggggacaaggtaccactttaaccgtcagcagc

SEQ ID NO: 153 - protein, 236 aa, Artificial Sequence
  source: /note="Description of Artificial Sequence: Synthetic polypeptide"
VQLQQSGPELVKPGASVKMSCKASGYTFTSYVIQWVKQKPGQGLEWIGSINPYNDYTKYNEKFKGKATLTSDKSSITAYMEFSSLTSEDSALYYCARWGDGNYWGRGTTLTVSSGGGGSGGGGSGGGGSDIEMTQSPAIMSASLGERVTMTCTASSSVSSSYFHWYQQKPGSSPKLCIYSTSNLASGVPPRFSGSGSTSYSLTISSMEAEDAATYFCHQYHRSPTFGGGTKLETKR

SEQ ID NO: 154 - DNA, 708 bp, Artificial Sequence
  source: /note="Description of Artificial Sequence: Synthetic polynucleotide"
gtccagctgcagcagagcggacccgaactcgtgaaacccggtgcttccgtgaaaatgtcttgtaaggccagcggatacaccttcacctcctatgtgatccagtgggtcaaacagaagcccggacaaggtctcgagtggatcggcagcatcaacccttacaacgactataccaaatacaacgagaagtttaagggaaaggctactttaacctccgacaaaagctccatcacagcctacatggagttcagctctttaacatccgaggacagcgctctgtactattgcgcccggtggggcgacggcaattactggggacggggcacaacactgaccgtgagcagcggaggcggaggctccggcggaggcggatctggcggtggcggctccgacatcgagatgacccagtcccccgctatcatgtccgcctctttaggcgagcgggtcacaatgacttgtacagcctcctccagcgtctcctcctcctacttccattggtaccaacagaaacccggaagctcccctaaactgtgcatctacagcaccagcaatctcgccagcggcgtgccccctaggttttccggaagcggaagcaccagctactctttaaccatctcctccatggaggctgaggatgccgccacctacttttgtcaccagtaccaccggtcccccaccttcggaggcggcaccaaactggagacaaagagg

SEQ ID NO: 155 - protein, 696 aa, Artificial Sequence; identical to SEQ ID NO: 85
  source: /note="Description of Artificial Sequence: Synthetic polypeptide"

SEQ ID NO: 156 - DNA, 2088 bp, Artificial Sequence; identical to SEQ ID NO: 86
  source: /note="Description of Artificial Sequence: Synthetic polynucleotide"

SEQ ID NO: 157 - protein, 714 aa, Artificial Sequence; identical to SEQ ID NO: 87
  source: /note="Description of Artificial Sequence: Synthetic polypeptide"

SEQ ID NO: 158 - DNA, 2142 bp, Artificial Sequence; identical to SEQ ID NO: 88
  source: /note="Description of Artificial Sequence: Synthetic polynucleotide"

SEQ ID NO: 159 - DNA, 399 bp, Artificial Sequence
  source: /note="Description of Artificial Sequence: Synthetic polynucleotide"
gcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactaact

SEQ ID NO: 160 - DNA, 399 bp, Artificial Sequence
  source: /note="Description of Artificial Sequence: Synthetic polynucleotide"
gcccccacctcctcctccaccaagaagacccagctgcagctggagcatttactgctggatttacagatgattttaaacggcatcaacaactacaagaaccccaagctgactcgtatgctgaccttcaagttctacatgcccaagaaggccaccgagctgaagcatttacagtgtttagaggaggagctgaagcccctcgaggaggtgctgaatttagcccagtccaagaatttccatttaaggccccgggatttaatcagcaacatcaacgtgatcgttttagagctgaagggctccgagaccaccttcatgtgcgagtacgccgacgagaccgccaccatcgtggagtttttaaatcgttggatcaccttctgccagtccatcatctccactttaacc

SEQ ID NO: 161 - protein, 485 aa, Artificial Sequence
  source: /note="Description of Artificial Sequence: Synthetic polypeptide"
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 162 - DNA, 1455 bp, Artificial Sequence
  source: /note="Description of Artificial Sequence: Synthetic polynucleotide"
gcccccacctcctcctccaccaagaagacccagctgcagctggagcatttactgctggatttacagatgattttaaacggcatcaacaactacaagaaccccaagctgactcgtatgctgaccttcaagttctacatgcccaagaaggccaccgagctgaagcatttacagtgtttagaggaggagctgaagcccctcgaggaggtgctgaatttagcccagtccaagaatttccatttaaggccccgggatttaatcagcaacatcaacgtgatcgttttagagctgaagggctccgagaccaccttcatgtgcgagtacgccgacgagaccgccaccatcgtggagtttttaaatcgttggatcaccttctgccagtccatcatctccactttaaccagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggaggcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactaact

SEQ ID NO: 163 - protein, 503 aa, Artificial Sequence
  source: /note="Description of Artificial Sequence: Synthetic polypeptide"
MKWVTFISLLFLFSSAYSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 164 - DNA, 1509 bp, Artificial Sequence
  source: /note="Description of Artificial Sequence: Synthetic polynucleotide"
atgaagtgggtgaccttcatcagcctgctgttcctgttctccagcgcctactccgcccccacctcctcctccaccaagaagacccagctgcagctggagcatttactgctggatttacagatgattttaaacggcatcaacaactacaagaaccccaagctgactcgtatgctgaccttcaagttctacatgcccaagaaggccaccgagctgaagcatttacagtgtttagaggaggagctgaagcccctcgaggaggtgctgaatttagcccagtccaagaatttccatttaaggccccgggatttaatcagcaacatcaacgtgatcgttttagagctgaagggctccgagaccaccttcatgtgcgagtacgccgacgagaccgccaccatcgtggagtttttaaatcgttggatcaccttctgccagtccatcatctccactttaaccagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggaggcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactaact

SEQ ID NO: 165 - DNA, 342 bp, Artificial Sequence
  source: /note="Description of Artificial Sequence: Synthetic polynucleotide"
aactgggtgaacgtgatcagcgatttaaagaagatcgaggatttaatccagagcatgcacatcgacgccactctgtacactgagagcgacgtgcaccctagctgcaaggtgactgccatgaagtgctttttactggagctgcaagttatctctttagagagcggcgatgccagcatccacgacactgtggagaatttaatcattttagccaacaactctttaagcagcaacggcaacgtgacagagagcggctgcaaggagtgcgaggagctggaggagaagaacatcaaggagtttttacagagcttcgtgcacatcgtgcagatgttcatcaacactagc

SEQ ID NO: 166 - DNA, 342 bp, Artificial Sequence; identical to SEQ ID NO: 116
  source: /note="Description of Artificial Sequence: Synthetic polynucleotide"

SEQ ID NO: 167 - protein, 447 aa, Artificial Sequence
  source: /note="Description of Artificial Sequence: Synthetic polypeptide"
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 168 - DNA, 1341 bp, Artificial Sequence
  source: /note="Description of Artificial Sequence: Synthetic polynucleotide"
aactgggtgaacgtgatcagcgatttaaagaagatcgaggatttaatccagagcatgcacatcgacgccactctgtacactgagagcgacgtgcaccctagctgcaaggtgactgccatgaagtgctttttactggagctgcaagttatctctttagagagcggcgatgccagcatccacgacactgtggagaatttaatcattttagccaacaactctttaagcagcaacggcaacgtgacagagagcggctgcaaggagtgcgaggagctggaggagaagaacatcaaggagtttttacagagcttcgtgcacatcgtgcagatgttcatcaacactagcagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 169 - protein, 465 aa, Artificial Sequence
  source: /note="Description of Artificial Sequence: Synthetic polypeptide"
MKWVTFISLLFLFSSAYSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 170 - DNA, 1395 bp, Artificial Sequence
  source: /note="Description of Artificial Sequence: Synthetic polynucleotide"
atgaagtgggtgaccttcatcagcctgctgttcctgttctccagcgcctactccaactgggtgaacgtgatcagcgatttaaagaagatcgaggatttaatccagagcatgcacatcgacgccactctgtacactgagagcgacgtgcaccctagctgcaaggtgactgccatgaagtgctttttactggagctgcaagttatctctttagagagcggcgatgccagcatccacgacactgtggagaatttaatcattttagccaacaactctttaagcagcaacggcaacgtgacagagagcggctgcaaggagtgcgaggagctggaggagaagaacatcaaggagtttttacagagcttcgtgcacatcgtgcagatgttcatcaacactagcagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 171 - DNA, 471 bp, Homo sapiens
tacttcggcaaactggaatccaagctgagcgtgatccggaatttaaacgaccaagttctgtttatcgatcaaggtaaccggcctctgttcgaggacatgaccgactccgattgccgggacaatgccccccggaccatcttcattatctccatgtacaaggacagccagccccggggcatggctgtgacaattagcgtgaagtgtgagaaaatcagcactttatcttgtgagaacaagatcatctcctttaaggaaatgaacccccccgataacatcaaggacaccaagtccgatatcatcttcttccagcggtccgtgcccggtcacgataacaagatgcagttcgaatcctcctcctacgagggctactttttagcttgtgaaaaggagagggatttattcaagctgatcctcaagaaggaggacgagctgggcgatcgttccatcatgttcaccgtccaaaacgaggat

SEQ ID NO: 172 - DNA, 918 bp, Homo sapiens
atttgggaactgaagaaggacgtctacgtggtcgaactggactggtatcccgatgctcccggcgaaatggtggtgctcacttgtgacacccccgaagaagacggcatcacttggaccctcgatcagagcagcgaggtgctgggctccggaaagaccctcacaatccaagttaaggagttcggagacgctggccaatacacatgccacaagggaggcgaggtgctcagccattccttattattattacacaagaaggaagacggaatctggtccaccgacattttaaaagatcagaaggagcccaagaataagacctttttaaggtgtgaggccaaaaactacagcggtcgtttcacttgttggtggctgaccaccatttccaccgatttaaccttctccgtgaaaagcagccggggaagctccgaccctcaaggtgtgacatgtggagccgctaccctcagcgctgagagggttcgtggcgataacaaggaatacgagtacagcgtggagtgccaagaagatagcgcttgtcccgctgccgaagaatctttacccattgaggtgatggtggacgccgtgcacaaactcaagtacgagaactacacctcctccttctttatccgggacatcattaagcccgatcctcctaagaatttacagctgaagcctctcaaaaatagccggcaagttgaggtctcttgggaatatcccgacacttggagcacaccccacagctacttctctttaaccttttgtgtgcaagttcaaggtaaaagcaagcgggagaagaaagaccgggtgtttaccgacaaaaccagcgccaccgtcatctgtcggaagaacgcctccatcagcgtgagggctcaagatcgttattactccagcagctggtccgagtgggccagcgtgccttgttcc

SEQ ID NO: 173 - DNA, 591 bp, Homo sapiens
cgtaacctccccgtggctacccccgatcccggaatgttcccttgtttacaccacagccagaatttactgagggccgtgagcaacatgctgcagaaagctaggcagactttagaattttacccttgcaccagcgaggagatcgaccatgaagatatcaccaaggacaagacatccaccgtggaggcttgtttacctctggagctgacaaagaacgagtcttgtctcaactctcgtgaaaccagcttcatcacaaatggctcttgtttagcttcccggaagacctcctttatgatggctttatgcctcagctccatctacgaggatttaaagatgtaccaagtggagttcaagaccatgaacgccaagctgctcatggaccctaaacggcagatctttttagaccagaacatgctggctgtgattgatgagctgatgcaagctttaaacttcaactccgagaccgtccctcagaagtcctccctcgaggagcccgatttttacaagacaaagatcaaactgtgcattttactccacgcctttaggatccgggccgtgaccattgaccgggtcatgagctatttaaacgccagc

SEQ ID NO: 174 - protein, 490 aa, Artificial Sequence
  source: /note="Description of Artificial Sequence: Synthetic polypeptide"
YFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNEDSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 175 - DNA, 1470 bp, Artificial Sequence
  source: /note="Description of Artificial Sequence: Synthetic polynucleotide"
tacttcggcaaactggaatccaagctgagcgtgatccggaatttaaacgaccaagttctgtttatcgatcaaggtaaccggcctctgttcgaggacatgaccgactccgattgccgggacaatgccccccggaccatcttcattatctccatgtacaaggacagccagccccggggcatggctgtgacaattagcgtgaagtgtgagaaaatcagcactttatcttgtgagaacaagatcatctcctttaaggaaatgaacccccccgataacatcaaggacaccaagtccgatatcatcttcttccagcggtccgtgcccggtcacgataacaagatgcagttcgaatcctcctcctacgagggctactttttagcttgtgaaaaggagagggatttattcaagctgatcctcaagaaggaggacgagctgggcgatcgttccatcatgttcaccgtccaaaacgaggatagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 176 - protein, 508 aa, Artificial Sequence
  source: /note="Description of Artificial Sequence: Synthetic polypeptide"
MKWVTFISLLFLFSSAYSYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNEDSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 177 - DNA, 1524 bp, Artificial Sequence
  source: /note="Description of Artificial Sequence: Synthetic polynucleotide"
atgaagtgggtcacatttatctctttactgttcctcttctccagcgcctacagctacttcggcaaactggaatccaagctgagcgtgatccggaatttaaacgaccaagttctgtttatcgatcaaggtaaccggcctctgttcgaggacatgaccgactccgattgccgggacaatgccccccggaccatcttcattatctccatgtacaaggacagccagccccggggcatggctgtgacaattagcgtgaagtgtgagaaaatcagcactttatcttgtgagaacaagatcatctcctttaaggaaatgaacccccccgataacatcaaggacaccaagtccgatatcatcttcttccagcggtccgtgcccggtcacgataacaagatgcagttcgaatcctcctcctacgagggctactttttagcttgtgaaaaggagagggatttattcaagctgatcctcaagaaggaggacgagctgggcgatcgttccatcatgttcaccgtccaaaacgaggatagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 178 - protein, 583 aa, Artificial Sequence
  source: /note="Description of Artificial Sequence: Synthetic polypeptide"
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASITCPPPMSVEHADIWVKSYSLYSRERYICNSGFKRKAGTSSLTECVLNKATNVAHWTTPSLKCIR

SEQ ID NO: 179 - DNA, 1749 bp, Artificial Sequence
  source: /note="Description of Artificial Sequence: Synthetic polynucleotide"
atttgggaactgaagaaggacgtctacgtggtcgaactggactggtatcccgatgctcccggcgaaatggtggtgctcacttgtgacacccccgaagaagacggcatcacttggaccctcgatcagagcagcgaggtgctgggctccggaaagaccctcacaatccaagttaaggagttcggagacgctggccaatacacatgccacaagggaggcgaggtgctcagccattccttattattattacacaagaaggaagacggaatctggtccaccgacattttaaaagatcagaaggagcccaagaataagacctttttaaggtgtgaggccaaaaactacagcggtcgtttcacttgttggtggctgaccaccatttccaccgatttaaccttctccgtgaaaagcagccggggaagctccgaccctcaaggtgtgacatgtggagccgctaccctcagcgctgagagggttcgtggcgataacaaggaatacgagtacagcgtggagtgccaagaagatagcgcttgtcccgctgccgaagaatctttacccattgaggtgatggtggacgccgtgcacaaactcaagtacgagaactacacctcctccttctttatccgggacatcattaagcccgatcctcctaagaatttacagctgaagcctctcaaaaatagccggcaagttgaggtctcttgggaatatcccgacacttggagcacaccccacagctacttctctttaaccttttgtgtgcaagttcaaggtaaaagcaagcgggagaagaaagaccgggtgtttaccgacaaaaccagcgccaccgtcatctgtcggaagaacgcctccatcagcgtgagggctcaagatcgttattactccagcagctggtccgagtgggccagcgtgccttgttccggcggtggaggatccggaggaggtggctccggcggcggaggatctcgtaacctccccgtggctacccccgatcccggaatgttcccttgtttacaccacagccagaatttactgagggccgtgagcaacatgctgcagaaagctaggcagactttagaattttacccttgcaccagcgaggagatcgaccatgaagatatcaccaaggacaagacatccaccgtggaggcttgtttacctctggagctgacaaagaacgagtcttgtctcaactctcgtgaaaccagcttcatcacaaatggctcttgtttagcttcccggaagacctcctttatgatggctttatgcctcagctccatctacgaggatttaaagatgtaccaagtggagttcaagaccatgaacgccaagctgctcatggaccctaaacggcagatctttttagaccagaacatgctggctgtgattgatgagctgatgcaagctttaaacttcaactccgagaccgtccctcagaagtcctccctcgaggagcccgatttttacaagacaaagatcaaactgtgcattttactccacgcctttaggatccgggccgtgaccattgaccgggtcatgagctatttaaacgccagcattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccgg

SEQ ID NO: 180 - protein, 601 aa, Artificial Sequence
  source: /note="Description of Artificial Sequence: Synthetic polypeptide"
MKWVTFISLLFLFSSAYSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASITCPPPMSVEHADIWVKSYSLYSRERYICNSGFKRKAGTSSLTECVLNKATNVAHWTTPSLKCIR

SEQ ID NO: 181 - DNA, 1803 bp, Artificial Sequence
  source: /note="Description of Artificial Sequence: Synthetic polynucleotide"
atgaaatgggtgacctttatttctttactgttcctctttagcagcgcctactccatttgggaactgaagaaggacgtctacgtggtcgaactggactggtatcccgatgctcccggcgaaatggtggtgctcacttgtgacacccccgaagaagacggcatcacttggaccctcgatcagagcagcgaggtgctgggctccggaaagaccctcacaatccaagttaaggagttcggagacgctggccaatacacatgccacaagggaggcgaggtgctcagccattccttattattattacacaagaaggaagacggaatctggtccaccgacattttaaaagatcagaaggagcccaagaataagacctttttaaggtgtgaggccaaaaactacagcggtcgtttcacttgttggtggctgaccaccatttccaccgatttaaccttctccgtgaaaagcagccggggaagctccgaccctcaaggtgtgacatgtggagccgctaccctcagcgctgagagggttcgtggcgataacaaggaatacgagtacagcgtggagtgccaagaagatagcgcttgtcccgctgccgaagaatctttacccattgaggtgatggtggacgccgtgcacaaactcaagtacgagaactacacctcctccttctttatccgggacatcattaagcccgatcctcctaagaatttacagctgaagcctctcaaaaatagccggcaagttgaggtctcttgggaatatcccgacacttggagcacaccccacagctacttctctttaaccttttgtgtgcaagttcaaggtaaaagcaagcgggagaagaaagaccgggtgtttaccgacaaaaccagcgccaccgtcatctgtcggaagaacgcctccatcagcgtgagggctcaagatcgttattactccagcagctggtccgagtgggccagcgtgccttgttccggcggtggaggatccggaggaggtggctccggcggcggaggatctcgtaacctccccgtggctacccccgatcccggaatgttcccttgtttacaccacagccagaatttactgagggccgtgagcaacatgctgcagaaagctaggcagactttagaattttacccttgcaccagcgaggagatcgaccatgaagatatcaccaaggacaagacatccaccgtggaggcttgtttacctctggagctgacaaagaacgagtcttgtctcaactctcgtgaaaccagcttcatcacaaatggctcttgtttagcttcccggaagacctcctttatgatggctttatgcctcagctccatctacgaggatttaaagatgtaccaagtggagttcaagaccatgaacgccaagctgctcatggaccctaaacggcagatctttttagaccagaacatgctggctgtgattgatgagctgatgcaagctttaaacttcaactccgagaccgtccctcagaagtcctccctcgaggagcccgatttttacaagacaaagatcaaactgtgcattttactccacgcctttaggatccgggccgtgaccattgaccgggtcatgagctatttaaacgccagcattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccgg

SEQ ID NO: 182 - DNA, 399 bp, Homo sapiens
cagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactcc

SEQ ID NO: 183 - protein, 136 aa, Artificial Sequence
  source: /note="Description of Artificial Sequence: Synthetic polypeptide"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 184 - protein, 136 aa, Artificial Sequence; identical to SEQ ID NO: 183
  source: /note="Description of Artificial Sequence: Synthetic polypeptide"

SEQ ID NO: 185 - DNA, 408 bp, Artificial Sequence
  source: /note="Description of Artificial Sequence: Synthetic polynucleotide"
atccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcacgatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgat

SEQ ID NO: 186 - DNA, 408 bp, Artificial Sequence
  source: /note="Description of Artificial Sequence: Synthetic polynucleotide"
attcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgcacaatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgac

SEQ ID NO: 187 - DNA, 861 bp, Artificial Sequence
  source: /note="Description of Artificial Sequence: Synthetic polynucleotide"
atccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcacgatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgcacaatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgac

SEQ ID NO: 188 - protein, 287 aa, Homo sapiens
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 189 - protein, 466 aa, Artificial Sequence
  source: /note="Description of Artificial Sequence: Synthetic polypeptide"
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 190 - DNA, 1398 bp, Artificial Sequence
  source: /note="Description of Artificial Sequence: Synthetic polynucleotide"
cagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactcctccggcaccaccaataccgtggccgcttataacctcacatggaagagcaccaacttcaagacaattctggaatgggaacccaagcccgtcaatcaagtttacaccgtgcagatctccaccaaatccggagactggaagagcaagtgcttctacacaacagacaccgagtgtgatttaaccgacgaaatcgtcaaggacgtcaagcaaacctatctggctcgggtcttttcctaccccgctggcaatgtcgagtccaccggctccgctggcgagcctctctacgagaattcccccgaattcaccccttatttagagaccaatttaggccagcctaccatccagagcttcgagcaagttggcaccaaggtgaacgtcaccgtcgaggatgaaaggactttagtgcggcggaataacacatttttatccctccgggatgtgttcggcaaagacctcatctacacactgtactattggaagtccagctcctccggcaaaaagaccgctaagaccaacaccaacgagtttttaattgacgtggacaaaggcgagaactactgcttcagcgtgcaagccgtgatcccttctcgtaccgtcaaccggaagagcacagattcccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 191 - protein, 484 aa, Artificial Sequence
  source: /note="Description of Artificial Sequence: Synthetic polypeptide"
MKWVTFISLLFLFSSAYSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 192 - DNA, 1452 bp, Artificial Sequence
  source: /note="Description of Artificial Sequence: Synthetic polynucleotide"
atgaagtgggtgaccttcatcagcctgctgttcctgttctccagcgcctactcccagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactcctccggcaccaccaataccgtggccgcttataacctcacatggaagagcaccaacttcaagacaattctggaatgggaacccaagcccgtcaatcaagtttacaccgtgcagatctccaccaaatccggagactggaagagcaagtgcttctacacaacagacaccgagtgtgatttaaccgacgaaatcgtcaaggacgtcaagcaaacctatctggctcgggtcttttcctaccccgctggcaatgtcgagtccaccggctccgctggcgagcctctctacgagaattcccccgaattcaccccttatttagagaccaatttaggccagcctaccatccagagcttcgagcaagttggcaccaaggtgaacgtcaccgtcgaggatgaaaggactttagtgcggcggaataacacatttttatccctccgggatgtgttcggcaaagacctcatctacacactgtactattggaagtccagctcctccggcaaaaagaccgctaagaccaacaccaacgagtttttaattgacgtggacaaaggcgagaactactgcttcagcgtgcaagccgtgatcccttctcgtaccgtcaaccggaagagcacagattcccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 193 - protein, 352 aa, Artificial Sequence
  source: /note="Description of Artificial Sequence: Synthetic polypeptide"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDITCPPPMSVEHADIWVKSYSLYSRERYICNSGFKRKAGTSSLTECVLNKATNVAHWTTPSLKCIR

SEQ ID NO: 194 - DNA, 1056 bp, Artificial Sequence
  source: /note="Description of Artificial Sequence: Synthetic polynucleotide"
atccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcacgatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgcacaatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacatcacgtgtcctcctcctatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgtattaga

SEQ ID NO: 195 - protein, 370 aa, Artificial Sequence
  source: /note="Description of Artificial Sequence: Synthetic polypeptide"
MKWVTFISLLFLFSSAYSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDITCPPPMSVEHADIWVKSYSLYSRERYICNSGFKRKAGTSSLTECVLNKATNVAHWTTPSLKCIR

SEQ ID NO: 196 - DNA, 1110 bp, Artificial Sequence
  source: /note="Description of Artificial Sequence: Synthetic polynucleotide"
atgaagtgggtgaccttcatcagcctgctgttcctgttctccagcgcctactccatccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcacgatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgcacaatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacatcacgtgtcctcctcctatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgtattaga

SEQ ID NO: 197 - DNA, 399 bp, Homo sapiens
caaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgttttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaagatgattcatcagcatctgtcctctagaacacacggaagtgaagattcc

SEQ ID NO: 198 - DNA, 456 bp, Homo sapiens
gattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacac

SEQ ID NO: 199 - protein, 466 aa, Artificial Sequence; identical to SEQ ID NO: 189
  source: /note="Description of Artificial Sequence: Synthetic polypeptide"

SEQ ID NO: 200 - DNA, 1398 bp, Artificial Sequence
  source: /note="Description of Artificial Sequence: Synthetic polynucleotide"
caaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgttttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaagatgattcatcagcatctgtcctctagaacacacggaagtgaagattcctcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 201 - protein, 483 aa, Artificial Sequence
  source: /note="Description of Artificial Sequence: Synthetic polypeptide"
MGVKVLFALICIAVAEAQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 202 - DNA, 1449 bp, Artificial Sequence
  source: /note="Description of Artificial Sequence: Synthetic polynucleotide"
atgggagtgaaagttctttttgcccttatttgtattgctgtggccgaggcccaaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgttttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaagatgattcatcagcatctgtcctctagaacacacggaagtgaagattcctcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 203 - protein, 217 aa, Artificial Sequence
  source: /note="Description of Artificial Sequence: Synthetic polypeptide"
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEHITCPPPMSVEHADIWVKSYSLYSRERYICNSGFKRKAGTSSLTECVLNKATNVAHWTTPSLKCIR

SEQ ID NO: 204 - DNA, 651 bp, Artificial Sequence
  source: /note="Description of Artificial Sequence: Synthetic polynucleotide"
gattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacacatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaga

SEQ ID NO: 205 - protein, 234 aa, Artificial Sequence
  source: /note="Description of Artificial Sequence: Synthetic polypeptide"
MGVKVLFALICIAVAEADCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEHITCPPPMSVEHADIWVKSYSLYSRERYICNSGFKRKAGTSSLTECVLNKATNVAHWTTPSLKCIR

SEQ ID NO: 206 - DNA, 702 bp, Artificial Sequence
  source: /note="Description of Artificial Sequence: Synthetic polynucleotide"
atgggagtgaaagttctttttgcccttatttgtattgctgtggccgaggccgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacacatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaga

SEQ ID NO: 207 - protein, 485 aa, Artificial Sequence
  source: /note="Description of Artificial Sequence: Synthetic polypeptide"
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEHSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 208 - DNA, 1455 bp, Artificial Sequence
  source: /note="Description of Artificial Sequence: Synthetic polynucleotide"
gattgcgacatcgagggcaaggacggcaagcagtacgagagcgtgctgatggtgtccatcgaccagctgctggacagcatgaaggagatcggctccaactgcctcaacaacgagttcaacttcttcaagcggcacatctgcgacgccaacaaggagggcatgttcctgttcagggccgccaggaaactgcggcagttcctgaagatgaactccaccggcgacttcgacctgcacctgctgaaggtgtccgagggcaccaccatcctgctgaactgcaccggacaggtgaagggccggaaacctgctgctctgggagaggcccaacccaccaagagcctggaggagaacaagtccctgaaggagcagaagaagctgaacgacctgtgcttcctgaagaggctgctgcaggagatcaagacctgctggaacaagatcctgatgggcaccaaggagcatagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 209 - protein, 503 aa, Artificial Sequence
  source: /note="Description of Artificial Sequence: Synthetic polypeptide"
MKWVTFISLLFLFSSAYSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEHSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 210 - DNA, 1509 bp, Artificial Sequence
  source: /note="Description of Artificial Sequence: Synthetic polynucleotide"
atgaagtgggtgaccttcatcagcctgctgttcctgttctccagcgcctactccgattgcgacatcgagggcaaggacggcaagcagtacgagagcgtgctgatggtgtccatcgaccagctgctggacagcatgaaggagatcggctccaactgcctcaacaacgagttcaacttcttcaagcggcacatctgcgacgccaacaaggagggcatgttcctgttcagggccgccaggaaactgcggcagttcctgaagatgaactccaccggcgacttcgacctgcacctgctgaaggtgtccgagggcaccaccatcctgctgaactgcaccggacaggtgaagggccggaaacctgctgctctgggagaggcccaacccaccaagagcctggaggagaacaagtccctgaaggagcagaagaagctgaacgacctgtgcttcctgaagaggctgctgcaggagatcaagacctgctggaacaagatcctgatgggcaccaaggagcatagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 211 - protein, 198 aa, Artificial Sequence
  source: /note="Description of Artificial Sequence: Synthetic polypeptide"
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSITCPPPMSVEHADIWVKSYSLYSRERYICNSGFKRKAGTSSLTECVLNKATNVAHWTTPSLKCIR

SEQ ID NO: 212 - DNA, 594 bp, Artificial Sequence
  source: /note="Description of Artificial Sequence: Synthetic polynucleotide"
cagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactccattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccgg

SEQ ID NO: 213 - protein, 216 aa, Artificial Sequence
  source: /note="Description of Artificial Sequence: Synthetic polypeptide"
MKWVTFISLLFLFSSAYSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSITCPPPMSVEHADIWVKSYSLYSRERYICNSGFKRKAGTSSLTECVLNKATNVAHWTTPSLKCIR

SEQ ID NO: 214 - DNA, 648 bp, Artificial Sequence
  source: /note="Description of Artificial Sequence: Synthetic polynucleotide"
atgaagtgggtgaccttcatcagcctgctgttcctgttctccagcgcctactcccagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactccattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccgg

SEQ ID NO: 215 - protein, 108 aa, Artificial Sequence
  source: /note="Description of Artificial Sequence: Synthetic polypeptide"
SELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVGH

SEQ ID NO: 216 - DNA, 324 bp, Artificial Sequence
  source: /note="Description of Artificial Sequence: Synthetic polynucleotide"
tccgagctgacccaggaccctgctgtgtccgtggctctgggccagaccgtgaggatcacctgccagggcgactccctgaggtcctactacgcctcctggtaccagcagaagcccggccaggctcctgtgctggtgatctacggcaagaacaacaggccctccggcatccctgacaggttctccggatcctcctccggcaacaccgcctccctgaccatcacaggcgctcaggccgaggacgaggctgactactactgcaactccagggactcctccggcaaccatgtggtgttcggcggcggcaccaagctgaccgtgggccat

SEQ ID NO: 217 - protein, 117 aa, Artificial Sequence
  source: /note="Description of Artificial Sequence: Synthetic polypeptide"
EVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSR

SEQ ID NO: 218 - DNA, 351 bp, Artificial Sequence
  source: /note="Description of Artificial Sequence: Synthetic polynucleotide"
gaggtgcagctggtggagtccggaggaggagtggtgaggcctggaggctccctgaggctgagctgtgctgcctccggcttcaccttcgacgactacggcatgtcctgggtgaggcaggctcctggaaagggcctggagtgggtgtccggcatcaactggaacggcggatccaccggctacgccgattccgtgaagggcaggttcaccatcagcagggacaacgccaagaactccctgtacctgcagatgaactccctgagggccgaggacaccgccgtgtactactgcgccaggggcaggtccctgctgttcgactactggggacagggcaccctggtgaccgtgtccagg

SEQ ID NO: 219-220 - skipped (2 entries)

SEQ ID NO: 221 - protein, 508 aa, Artificial Sequence; identical to SEQ ID NO: 176
  source: /note="Description of Artificial Sequence: Synthetic polypeptide"

SEQ ID NO: 222 - protein, 18 aa, Artificial Sequence
  source: /note="Description of Artificial Sequence: Synthetic peptide"
GGSSRSSSSGGGGSGGGG

SEQ ID NO: 223 - protein, 823 aa, Artificial Sequence
  source: /note="Description of Artificial Sequence: Synthetic polypeptide"
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASITCPPPMSVEHADIWVKSYSLYSRERYICNSGFKRKAGTSSLTECVLNKATNVAHWTTPSLKCIRSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVGHGGGGSGGGGSGGGGSEVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSR

SEQ ID NO: 224 - DNA, 2469 bp, Artificial Sequence
  source: /note="Description of Artificial Sequence: Synthetic polynucleotide"
atttgggaactgaagaaggacgtctacgtggtcgaactggactggtatcccgatgctcccggcgaaatggtggtgctcacttgtgacacccccgaagaagacggcatcacttggaccctcgatcagagcagcgaggtgctgggctccggaaagaccctcacaatccaagttaaggagttcggagacgctggccaatacacatgccacaagggaggcgaggtgctcagccattccttattattattacacaagaaggaagacggaatctggtccaccgacattttaaaagatcagaaggagcccaagaataagacctttttaaggtgtgaggccaaaaactacagcggtcgtttcacttgttggtggctgaccaccatttccaccgatttaaccttctccgtgaaaagcagccggggaagctccgaccctcaaggtgtgacatgtggagccgctaccctcagcgctgagagggttcgtggcgataacaaggaatacgagtacagcgtggagtgccaagaagatagcgcttgtcccgctgccgaagaatctttacccattgaggtgatggtggacgccgtgcacaaactcaagtacgagaactacacctcctccttctttatccgggacatcattaagcccgatcctcctaagaatttacagctgaagcctctcaaaaatagccggcaagttgaggtctcttgggaatatcccgacacttggagcacaccccacagctacttctctttaaccttttgtgtgcaagttcaaggtaaaagcaagcgggagaagaaagaccgggtgtttaccgacaaaaccagcgccaccgtcatctgtcggaagaacgcctccatcagcgtgagggctcaagatcgttattactccagcagctggtccgagtgggccagcgtgccttgttccggcggtggaggatccggaggaggtggctccggcggcggaggatctcgtaacctccccgtggctacccccgatcccggaatgttcccttgtttacaccacagccagaatttactgagggccgtgagcaacatgctgcagaaagctaggcagactttagaattttacccttgcaccagcgaggagatcgaccatgaagatatcaccaaggacaagacatccaccgtggaggcttgtttacctctggagctgacaaagaacgagtcttgtctcaactctcgtgaaaccagcttcatcacaaatggctcttgtttagcttcccggaagacctcctttatgatggctttatgcctcagctccatctacgaggatttaaagatgtaccaagtggagttcaagaccatgaacgccaagctgctcatggaccctaaacggcagatctttttagaccagaacatgctggctgtgattgatgagctgatgcaagctttaaacttcaactccgagaccgtccctcagaagtcctccctcgaggagcccgatttttacaagacaaagatcaaactgtgcattttactccacgcctttaggatccgggccgtgaccattgaccgggtcatgagctatttaaacgccagcattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggtccgagctgacccaggaccctgctgtgtccgtggctctgggccagaccgtgaggatcacctgccagggcgactccctgaggtcctactacgcctcctggtaccagcagaagcccggccaggctcctgtgctggtgatctacggcaagaacaacaggccctccggcatccctgacaggttctccggatcctcctccggcaacaccgcctccctgaccatcacaggcgctcaggccgaggacgaggctgactactactgcaactccagggactcctccggcaaccatgtggtgttcggcggcggcaccaagctgaccgtgggccatggcggcggcggctccggaggcggcggcagcggcggaggaggatccgaggtgcagctggtggagtccggaggaggagtggtgaggcctggaggctccctgaggctgagctgtgctgcctccggcttcaccttcgacgactacggcatgtcctgggtgaggcaggctcctggaaagggcctggagtgggtgtccggcatcaactggaacggcggatccaccggctacgccgattccgtgaagggcaggttcaccatcagcagggacaacgccaagaactccctgtacctgcagatgaactccctgagggccgaggacaccgccgtgtactactgcgccaggggcaggtccctgctgttcgactactggggacagggcaccctggtgaccgtgtccagg

SEQ ID NO: 225 - protein, 841 aa, Artificial Sequence
  source: /note="Description of Artificial Sequence: Synthetic polypeptide"
MKWVTFISLLFLFSSAYSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASITCPPPMSVEHADIWVKSYSLYSRERYICNSGFKRKAGTSSLTECVLNKATNVAHWTTPSLKCIRSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVGHGGGGSGGGGSGGGGSEVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSR

SEQ ID NO: 226 - DNA, 2523 bp, Artificial Sequence
  source: /note="Description of Artificial Sequence: Synthetic polynucleotide"
atgaaatgggtgacctttatttctttactgttcctctttagcagcgcctactccatttgggaactgaagaaggacgtctacgtggtcgaactggactggtatcccgatgctcccggcgaaatggtggtgctcacttgtgacacccccgaagaagacggcatcacttggaccctcgatcagagcagcgaggtgctgggctccggaaagaccctcacaatccaagttaaggagttcggagacgctggccaatacacatgccacaagggaggcgaggtgctcagccattccttattattattacacaagaaggaagacggaatctggtccaccgacattttaaaagatcagaaggagcccaagaataagacctttttaaggtgtgaggccaaaaactacagcggtcgtttcacttgttggtggctgaccaccatttccaccgatttaaccttctccgtgaaaagcagccggggaagctccgaccctcaaggtgtgacatgtggagccgctaccctcagcgctgagagggttcgtggcgataacaaggaatacgagtacagcgtggagtgccaagaagatagcgcttgtcccgctgccgaagaatctttacccattgaggtgatggtggacgccgtgcacaaactcaagtacgagaactacacctcctccttctttatccgggacatcattaagcccgatcctcctaagaatttacagctgaagcctctcaaaaatagccggcaagttgaggtctcttgggaatatcccgacacttggagcacaccccacagctacttctctttaaccttttgtgtgcaagttcaaggtaaaagcaagcgggagaagaaagaccgggtgtttaccgacaaaaccagcgccaccgtcatctgtcggaagaacgcctccatcagcgtgagggctcaagatcgttattactccagcagctggtccgagtgggccagcgtgccttgttccggcggtggaggatccggaggaggtggctccggcggcggaggatctcgtaacctccccgtggctacccccgatcccggaatgttcccttgtttacaccacagccagaatttactgagggccgtgagcaacatgctgcagaaagctaggcagactttagaattttacccttgcaccagcgaggagatcgaccatgaagatatcaccaaggacaagacatccaccgtggaggcttgtttacctctggagctgacaaagaacgagtcttgtctcaactctcgtgaaaccagcttcatcacaaatggctcttgtttagcttcccggaagacctcctttatgatggctttatgcctcagctccatctacgaggatttaaagatgtaccaagtggagttcaagaccatgaacgccaagctgctcatggaccctaaacggcagatctttttagaccagaacatgctggctgtgattgatgagctgatgcaagctttaaacttcaactccgagaccgtccctcagaagtcctccctcgaggagcccgatttttacaagacaaagatcaaactgtgcattttactccacgcctttaggatccgggccgtgaccattgaccgggtcatgagctatttaaacgccagcattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggtccgagctgacccaggaccctgctgtgtccgtggctctgggccagaccgtgaggatcacctgccagggcgactccctgaggtcctactacgcctcctggtaccagcagaagcccggccaggctcctgtgctggtgatctacggcaagaacaacaggccctccggcatccctgacaggttctccggatcctcctccggcaacaccgcctccctgaccatcacaggcgctcaggccgaggacgaggctgactactactgcaactccagggactcctccggcaaccatgtggtgttcggcggcggcaccaagctgaccgtgggccatggcggcggcggctccggaggcggcggcagcggcggaggaggatccgaggtgcagctggtggagtccggaggaggagtggtgaggcctggaggctccctgaggctgagctgtgctgcctccggcttcaccttcgacgactacggcatgtcctgggtgaggcaggctcctggaaagggcctggagtgggtgtccggcatcaactggaacggcggatccaccggctacgccgattccgtgaagggcaggttcaccatcagcagggacaacgccaagaactccctgtacctgcagatgaactccctgagggccgaggacaccgccgtgtactactgcgccaggggcaggtccctgctgttcgactactggggacagggcaccctggtgaccgtgtccagg

SEQ ID NO: 227 - DNA, 456 bp, Homo sapiens
gattgcgacatcgagggcaaggacggcaagcagtacgagagcgtgctgatggtgtccatcgaccagctgctggacagcatgaaggagatcggctccaactgcctcaacaacgagttcaacttcttcaagcggcacatctgcgacgccaacaaggagggcatgttcctgttcagggccgccaggaaactgcggcagttcctgaagatgaactccaccggcgacttcgacctgcacctgctgaaggtgtccgagggcaccaccatcctgctgaactgcaccggacaggtgaagggccggaaacctgctgctctgggagaggcccaacccaccaagagcctggaggagaacaagtccctgaaggagcagaagaagctgaacgacctgtgcttcctgaagaggctgctgcaggagatcaagacctgctggaacaagatcctgatgggcaccaaggagcat

SEQ ID NO: 228-231 - skipped (4 entries)

SEQ ID NO: 232 - protein, 438 aa, Artificial Sequence
  source: /note="Description of Artificial Sequence: Synthetic polypeptide"
SELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVGHGGGGSGGGGSGGGGSEVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSRITCPPPMSVEHADIWVKSYSLYSRERYICNSGFKRKAGTSSLTECVLNKATNVAHWTTPSLKCIRQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 233 - DNA, 1314 bp, Artificial Sequence
  source: /note="Description of Artificial Sequence: Synthetic polynucleotide"
tccgagctgacccaggaccctgctgtgtccgtggctctgggccagaccgtgaggatcacctgccagggcgactccctgaggtcctactacgcctcctggtaccagcagaagcccggccaggctcctgtgctggtgatctacggcaagaacaacaggccctccggcatccctgacaggttctccggatcctcctccggcaacaccgcctccctgaccatcacaggcgctcaggccgaggacgaggctgactactactgcaactccagggactcctccggcaaccatgtggtgttcggcggcggcaccaagctgaccgtgggccatggcggcggcggctccggaggcggcggcagcggcggaggaggatccgaggtgcagctggtggagtccggaggaggagtggtgaggcctggaggctccctgaggctgagctgtgctgcctccggcttcaccttcgacgactacggcatgtcctgggtgaggcaggctcctggaaagggcctggagtgggtgtccggcatcaactggaacggcggatccaccggctacgccgattccgtgaagggcaggttcaccatcagcagggacaacgccaagaactccctgtacctgcagatgaactccctgagggccgaggacaccgccgtgtactactgcgccaggggcaggtccctgctgttcgactactggggacagggcaccctggtgaccgtgtccaggattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggcagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactcc

SEQ ID NO: 234 - protein, 456 aa, Artificial Sequence
  source: /note="Description of Artificial Sequence: Synthetic polypeptide"
MKWVTFISLLFLFSSAYSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVGHGGGGSGGGGSGGGGSEVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSRITCPPPMSVEHADIWVKSYSLYSRERYICNSGFKRKAGTSSLTECVLNKATNVAHWTTPSLKCIRQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 235 - DNA, 1368 bp, Artificial Sequence
  source: /note="Description of Artificial Sequence: Synthetic polynucleotide"
atgaagtgggtgaccttcatcagcctgctgttcctgttctccagcgcctactcctccgagctgacccaggaccctgctgtgtccgtggctctgggccagaccgtgaggatcacctgccagggcgactccctgaggtcctactacgcctcctggtaccagcagaagcccggccaggctcctgtgctggtgatctacggcaagaacaacaggccctccggcatccctgacaggttctccggatcctcctccggcaacaccgcctccctgaccatcacaggcgctcaggccgaggacgaggctgactactactgcaactccagggactcctccggcaaccatgtggtgttcggcggcggcaccaagctgaccgtgggccatggcggcggcggctccggaggcggcggcagcggcggaggaggatccgaggtgcagctggtggagtccggaggaggagtggtgaggcctggaggctccctgaggctgagctgtgctgcctccggcttcaccttcgacgactacggcatgtcctgggtgaggcaggctcctggaaagggcctggagtgggtgtccggcatcaactggaacggcggatccaccggctacgccgattccgtgaagggcaggttcaccatcagcagggacaacgccaagaactccctgtacctgcagatgaactccctgagggccgaggacaccgccgtgtactactgcgccaggggcaggtccctgctgttcgactactggggacagggcaccctggtgaccgtgtccaggattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggcagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactcc

SEQ ID NO: 236 - protein, 620 aa, Artificial Sequence
  source: /note="Description of Artificial Sequence: Synthetic polypeptide"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 237 - DNA, 1860 bp, Artificial Sequence
  source: /note="Description of Artificial Sequence: Synthetic polynucleotide"
atccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 238 - protein, 638 aa, Artificial Sequence
  source: /note="Description of Artificial Sequence: Synthetic polypeptide"
MKWVTFISLLFLFSSAYSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 239 - DNA, 1914 bp, Artificial Sequence
  source: /note="Description of Artificial Sequence: Synthetic polynucleotide"
atgaagtgggtgaccttcatcagcctgctgttcctgttctccagcgcctactccatccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 240 - protein, 352 aa, Artificial Sequence; identical to SEQ ID NO: 193
  source: /note="Description of Artificial Sequence: Synthetic polypeptide"

SEQ ID NO: 241 - DNA, 1056 bp, Artificial Sequence
  source: /note="Description of Artificial Sequence: Synthetic polynucleotide"
atccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccgg

SEQ ID NO: 242 - protein, 370 aa, Artificial Sequence; identical to SEQ ID NO: 195
  source: /note="Description of Artificial Sequence: Synthetic polypeptide"

SEQ ID NO: 243 - DNA, 1110 bp, Artificial Sequence
  source: /note="Description of Artificial Sequence: Synthetic polynucleotide"
atgaagtgggtgaccttcatcagcctgctgttcctgttctccagcgcctactccatccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccgg

SEQ ID NO: 244 - DNA, 1911 bp, Artificial Sequence
  source: /note="Description of Artificial Sequence: Synthetic polynucleotide"
atgggagtgaaagttctttttgcccttatttgtattgctgtggccgaggccatcccaccgcacgttcagaagtcggtgaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgactcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaaactgggtgaatgtaataagtaatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 245-249 - skipped (5 entries)

SEQ ID NO: 250 - protein, 235 aa, Artificial Sequence
  source: /note="Description of Artificial Sequence: Synthetic polypeptide"
MKWVTFISLLFLFSSAYSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEHITCPPPMSVEHADIWVKSYSLYSRERYICNSGFKRKAGTSSLTECVLNKATNVAHWTTPSLKCIR

SEQ ID NO: 251 - DNA, 705 bp, Artificial Sequence
  source: /note="Description of Artificial Sequence: Synthetic polynucleotide"
atgaagtgggtgaccttcatcagcctgctgttcctgttctccagcgcctactccgattgcgacatcgagggcaaggacggcaagcagtacgagagcgtgctgatggtgtccatcgaccagctgctggacagcatgaaggagatcggctccaactgcctcaacaacgagttcaacttcttcaagcggcacatctgcgacgccaacaaggagggcatgttcctgttcagggccgccaggaaactgcggcagttcctgaagatgaactccaccggcgacttcgacctgcacctgctgaaggtgtccgagggcaccaccatcctgctgaactgcaccggacaggtgaagggccggaaacctgctgctctgggagaggcccaacccaccaagagcctggaggagaacaagtccctgaaggagcagaagaagctgaacgacctgtgcttcctgaagaggctgctgcaggagatcaagacctgctggaacaagatcctgatgggcaccaaggagcatattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccgg

SEQ ID NO: 252-256 - skipped (5 entries)

SEQ ID NO: 257 - DNA, 1056 bp, Artificial Sequence; identical to SEQ ID NO: 241
  source: /note="Description of Artificial Sequence: Synthetic polynucleotide"

SEQ ID NO: 258 - skipped

SEQ ID NO: 259 - DNA, 1110 bp, Artificial Sequence; identical to SEQ ID NO: 243
  source: /note="Description of Artificial Sequence: Synthetic polynucleotide"

SEQ ID NO: 260 - protein, 184 aa, Homo sapiens
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 261 - DNA, 552 bp, Homo sapiens
cgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaa

SEQ ID NO: 262 - protein, 165 aa, Homo sapiens
DPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEI

SEQ ID NO: 263 - DNA, 495 bp, Homo sapiens
gatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatc

SEQ ID NO: 264-267 - skipped (4 entries)

SEQ ID NO: 268 - protein, 397 aa, Artificial Sequence
  source: /note="Description of Artificial Sequence: Synthetic polypeptide"
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSITCPPPMSVEHADIWVKSYSLYSRERYICNSGFKRKAGTSSLTECVLNKATNVAHWTTPSLKCIRGGGGSGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 269 - DNA, 1191 bp, Artificial Sequence
  source: /note="Description of Artificial Sequence: Synthetic polynucleotide"
cagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactccattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggggcggtggaggatccggaggaggtggctccggcggcggaggatctcgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaa

SEQ ID NO: 270 - protein, 415 aa, Artificial Sequence
  source: /note="Description of Artificial Sequence: Synthetic polypeptide"
MKWVTFISLLFLFSSAYSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSITCPPPMSVEHADIWVKSYSLYSRERYICNSGFKRKAGTSSLTECVLNKATNVAHWTTPSLKCIRGGGGSGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 271 - DNA, 1245 bp, Artificial Sequence
  source: /note="Description of Artificial Sequence: Synthetic polynucleotide"
atgaagtgggtgaccttcatcagcctgctgttcctgttctccagcgcctactcccagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactccattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggggcggtggaggatccggaggaggtggctccggcggcggaggatctcgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaa

SEQ ID NO: 272 - protein, 378 aa, Artificial Sequence
  source: /note="Description of Artificial Sequence: Synthetic polypeptide"
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSITCPPPMSVEHADIWVKSYSLYSRERYICNSGFKRKAGTSSLTECVLNKATNVAHWTTPSLKCIRGGGGSGGGGSGGGGSDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEI

SEQ ID NO: 273 - DNA, 1134 bp, Artificial Sequence
  source: /note="Description of Artificial Sequence: Synthetic polynucleotide"
cagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactccattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggggcggtggaggatccggaggaggtggctccggcggcggaggatctgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatc

SEQ ID NO: 274 - protein, 396 aa, Artificial Sequence
  source: /note="Description of Artificial Sequence: Synthetic polypeptide"
MKWVTFISLLFLFSSAYSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSITCPPPMSVEHADIWVKSYSLYSRERYICNSGFKRKAGTSSLTECVLNKATNVAHWTTPSLKCIRGGGGSGGGGSGGGGSDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEI

SEQ ID NO: 275 - DNA, 1188 bp, Artificial Sequence
  source: /note="Description of Artificial Sequence: Synthetic polynucleotide"
atgaagtgggtgaccttcatcagcctgctgttcctgttctccagcgcctactcccagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactccattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggggcggtggaggatccggaggaggtggctccggcggcggaggatctgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatc

SEQ ID NO: 276-299 - skipped (24 entries)

SEQ ID NO: 300 - protein, 485 aa, Artificial Sequence
  source: /note="Description of Artificial Sequence: Synthetic polypeptide"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDITCPPPMSVEHADIWVKSYSLYSRERYICNSGFKRKAGTSSLTECVLNKATNVAHWTTPSLKCIRQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 301 - DNA, 1455 bp, Artificial Sequence
  source: /note="Description of Artificial Sequence: Synthetic polynucleotide"
atccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggcagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactcc

SEQ ID NO: 302 - protein, 503 aa, Artificial Sequence
  source: /note="Description of Artificial Sequence: Synthetic polypeptide"
MKWVTFISLLFLFSSAYSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDITCPPPMSVEHADIWVKSYSLYSRERYICNSGFKRKAGTSSLTECVLNKATNVAHWTTPSLKCIRQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 303 - DNA, 1509 bp, Artificial Sequence
  source: /note="Description of Artificial Sequence: Synthetic polynucleotide"
atgaagtgggtgaccttcatcagcctgctgttcctgttctccagcgcctactccatccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggcagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactcc

SEQ ID NO: 304-307 - skipped (4 entries)

SEQ ID NO: 308 - protein, 592 aa, Artificial Sequence
  source: /note="Description of Artificial Sequence: Synthetic polypeptide"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDITCPPPMSVEHADIWVKSYSLYSRERYICNSGFKRKAGTSSLTECVLNKATNVAHWTTPSLKCIRSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVGHGGGGSGGGGSGGGGSEVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSR

SEQ ID NO: 309 - DNA, 1776 bp, Artificial Sequence
  source: /note="Description of Artificial Sequence: Synthetic polynucleotide"
atccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggtccgagctgacccaggaccctgctgtgtccgtggctctgggccagaccgtgaggatcacctgccagggcgactccctgaggtcctactacgcctcctggtaccagcagaagcccggccaggctcctgtgctggtgatctacggcaagaacaacaggccctccggcatccctgacaggttctccggatcctcctccggcaacaccgcctccctgaccatcacaggcgctcaggccgaggacgaggctgactactactgcaactccagggactcctccggcaaccatgtggtgttcggcggcggcaccaagctgaccgtgggccatggcggcggcggctccggaggcggcggcagcggcggaggaggatccgaggtgcagctggtggagtccggaggaggagtggtgaggcctggaggctccctgaggctgagctgtgctgcctccggcttcaccttcgacgactacggcatgtcctgggtgaggcaggctcctggaaagggcctggagtgggtgtccggcatcaactggaacggcggatccaccggctacgccgattccgtgaagggcaggttcaccatcagcagggacaacgccaagaactccctgtacctgcagatgaactccctgagggccgaggacaccgccgtgtactactgcgccaggggcaggtccctgctgttcgactactggggacagggcaccctggtgaccgtgtccagg

SEQ ID NO: 310 - protein, 610 aa, Artificial Sequence
  source: /note="Description of Artificial Sequence: Synthetic polypeptide"
MKWVTFISLLFLFSSAYSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDITCPPPMSVEHADIWVKSYSLYSRERYICNSGFKRKAGTSSLTECVLNKATNVAHWTTPSLKCIRSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVGHGGGGSGGGGSGGGGSEVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSR

SEQ ID NO: 311 - DNA, 1830 bp, Artificial Sequence
  source: /note="Description of Artificial Sequence: Synthetic polynucleotide"
atgaagtgggtgaccttcatcagcctgctgttcctgttctccagcgcctactccatccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggtccgagctgacccaggaccctgctgtgtccgtggctctgggccagaccgtgaggatcacctgccagggcgactccctgaggtcctactacgcctcctggtaccagcagaagcccggccaggctcctgtgctggtgatctacggcaagaacaacaggccctccggcatccctgacaggttctccggatcctcctccggcaacaccgcctccctgaccatcacaggcgctcaggccgaggacgaggctgactactactgcaactccagggactcctccggcaaccatgtggtgttcggcggcggcaccaagctgaccgtgggccatggcggcggcggctccggaggcggcggcagcggcggaggaggatccgaggtgcagctggtggagtccggaggaggagtggtgaggcctggaggctccctgaggctgagctgtgctgcctccggcttcaccttcgacgactacggcatgtcctgggtgaggcaggctcctggaaagggcctggagtgggtgtccggcatcaactggaacggcggatccaccggctacgccgattccgtgaagggcaggttcaccatcagcagggacaacgccaagaactccctgtacctgcagatgaactccctgagggccgaggacaccgccgtgtactactgcgccaggggcaggtccctgctgttcgactactggggacagggcaccctggtgaccgtgtccagg

SEQ ID NO: 312-315 - skipped (4 entries)

SEQ ID NO: 316 - protein, 551 aa, Artificial Sequence
  source: /note="Description of Artificial Sequence: Synthetic polypeptide"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDITCPPPMSVEHADIWVKSYSLYSRERYICNSGFKRKAGTSSLTECVLNKATNVAHWTTPSLKCIRGGGGSGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 317 - DNA, 1653 bp, Artificial Sequence
  source: /note="Description of Artificial Sequence: Synthetic polynucleotide"
atccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggggcggtggaggatccggaggaggtggctccggcggcggaggatctcgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaa

SEQ ID NO: 318 - protein, 569 aa, Artificial Sequence
  source: /note="Description of Artificial Sequence: Synthetic polypeptide"
MKWVTFISLLFLFSSAYSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDITCPPPMSVEHADIWVKSYSLYSRERYICNSGFKRKAGTSSLTECVLNKATNVAHWTTPSLKCIRGGGGSGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 319 - DNA, 1707 bp, Artificial Sequence
  source: /note="Description of Artificial Sequence: Synthetic polynucleotide"
atgaagtgggtgaccttcatcagcctgctgttcctgttctccagcgcctactccatccccccccatgtgcaaaagagcgtgaacaacgatatgatcgtgaccgacaacaacggcgccgtgaagtttccccagctctgcaagttctgcgatgtcaggttcagcacctgcgataatcagaagtcctgcatgtccaactgcagcatcacctccatctgcgagaagccccaagaagtgtgcgtggccgtgtggcggaaaaatgacgagaacatcaccctggagaccgtgtgtcacgaccccaagctcccttatcacgacttcattctggaggacgctgcctcccccaaatgcatcatgaaggagaagaagaagcccggagagaccttctttatgtgttcctgtagcagcgacgagtgtaacgacaacatcatcttcagcgaagagtacaacaccagcaaccctgatggaggtggcggatccggaggtggaggttctggtggaggtgggagtattcctccccacgtgcagaagagcgtgaataatgacatgatcgtgaccgataacaatggcgccgtgaaatttccccagctgtgcaaattctgcgatgtgaggttttccacctgcgacaaccagaagtcctgtatgagcaactgctccatcacctccatctgtgagaagcctcaggaggtgtgcgtggctgtctggcggaagaatgacgagaatatcaccctggaaaccgtctgccacgatcccaagctgccctaccacgatttcatcctggaagacgccgccagccctaagtgcatcatgaaagagaaaaagaagcctggcgagacctttttcatgtgctcctgcagcagcgacgaatgcaacgacaatatcatctttagcgaggaatacaataccagcaaccccgacattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccggggcggtggaggatccggaggaggtggctccggcggcggaggatctcgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaa

SEQ ID NO: 320 - DNA, 720 bp, Artificial Sequence
  source: /note="Description of Artificial Sequence: Synthetic polynucleotide"
atgaagtgggtcacatttatctctttactgttcctcttctccagcgcctacagctacttcggcaaactggaatccaagctgagcgtgatccggaatttaaacgaccaagttctgtttatcgatcaaggtaaccggcctctgttcgaggacatgaccgactccgattgccgggacaatgccccccggaccatcttcattatctccatgtacaaggacagccagccccggggcatggctgtgacaattagcgtgaagtgtgagaaaatcagcactttatcttgtgagaacaagatcatctcctttaaggaaatgaacccccccgataacatcaaggacaccaagtccgatatcatcttcttccagcggtccgtgcccggtcacgataacaagatgcagttcgaatcctcctcctacgagggctactttttagcttgtgaaaaggagagggatttattcaagctgatcctcaagaaggaggacgagctgggcgatcgttccatcatgttcaccgtccaaaacgaggatattacatgcccccctcccatgagcgtggagcacgccgacatctgggtgaagagctatagcctctacagccgggagaggtatatctgtaacagcggcttcaagaggaaggccggcaccagcagcctcaccgagtgcgtgctgaataaggctaccaacgtggctcactggacaacaccctctttaaagtgcatccgg

SEQ ID NO: 321 - DNA, 2607 bp, Artificial Sequence
  source: /note="Description of Artificial Sequence: Synthetic polynucleotide"
atgaaatgggtgacctttatttctttactgttcctctttagcagcgcctactccatttgggaactgaagaaggacgtctacgtggtcgaactggactggtatcccgatgctcccggcgaaatggtggtgctcacttgtgacacccccgaagaagacggcatcacttggaccctcgatcagagcagcgaggtgctgggctccggaaagaccctcacaatccaagttaaggagttcggagacgctggccaatacacatgccacaagggaggcgaggtgctcagccattccttattattattacacaagaaggaagacggaatctggtccaccgacattttaaaagatcagaaggagcccaagaataagacctttttaaggtgtgaggccaaaaactacagcggtcgtttcacttgttggtggctgaccaccatttccaccgatttaaccttctccgtgaaaagcagccggggaagctccgaccctcaaggtgtgacatgtggagccgctaccctcagcgctgagagggttcgtggcgataacaaggaatacgagtacagcgtggagtgccaagaagatagcgcttgtcccgctgccgaagaatctttacccattgaggtgatggtggacgccgtgcacaaactcaagtacgagaactacacctcctccttctttatccgggacatcattaagcccgatcctcctaagaatttacagctgaagcctctcaaaaatagccggcaagttgaggtctcttgggaatatcccgacacttggagcacaccccacagctacttctctttaaccttttgtgtgcaagttcaaggtaaaagcaagcgggagaagaaagaccgggtgtttaccgacaaaaccagcgccaccgtcatctgtcggaagaacgcctccatcagcgtgagggctcaagatcgttattactccagcagctggtccgagtgggccagcgtgccttgttccggcggtggaggatccggaggaggtggctccggcggcggaggatctcgtaacctccccgtggctacccccgatcccggaatgttcccttgtttacaccacagccagaatttactgagggccgtgagcaacatgctgcagaaagctaggcagactttagaattttacccttgcaccagcgaggagatcgaccatgaagatatcaccaaggacaagacatccaccgtggaggcttgtttacctctggagctgacaaagaacgagtcttgtctcaactctcgtgaaaccagcttcatcacaaatggctcttgtttagcttcccggaagacctcctttatgatggctttatgcctcagctccatctacgaggatttaaagatgtaccaagtggagttcaagaccatgaacgccaagctgctcatggaccctaaacggcagatctttttagaccagaacatgctggctgtgattgatgagctgatgcaagctttaaacttcaactccgagaccgtccctcagaagtcctccctcgaggagcccgatttttacaagacaaagatcaaactgtgcattttactccacgcctttaggatccgggccgtgaccattgaccgggtcatgagctatttaaacgccagcagcggcacaaccaacacagtcgctgcctataacctcacttggaagagcaccaacttcaaaaccatcctcgaatgggaacccaaacccgttaaccaagtttacaccgtgcagatcagcaccaagtccggcgactggaagtccaaatgtttctataccaccgacaccgagtgcgatctcaccgatgagatcgtgaaagatgtgaaacagacctacctcgcccgggtgtttagctaccccgccggcaatgtggagagcactggttccgctggcgagcctttatacgagaacagccccgaatttaccccttacctcgagaccaatttaggacagcccaccatccaaagctttgagcaagttggcacaaaggtgaatgtgacagtggaggacgagcggactttagtgcggcggaacaacacctttctcagcctccgggatgtgttcggcaaagatttaatctacacactgtattactggaagtcctcttcctccggcaagaagacagctaaaaccaacacaaacgagtttttaatcgacgtggataaaggcgaaaactactgtttcagcgtgcaagctgtgatcccctcccggaccgtgaataggaaaagcaccgatagccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 322 - protein, 240 aa, Artificial Sequence
  source: /note="Description of Artificial Sequence: Synthetic polypeptide"
MKWVTFISLLFLFSSAYSYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNEDITCPPPMSVEHADIWVKSYSLYSRERYICNSGFKRKAGTSSLTECVLNKATNVAHWTTPSLKCIR

SEQ ID NO: 323 - protein, 869 aa, Artificial Sequence
  source: /note="Description of Artificial Sequence: Synthetic polypeptide"
MKWVTFISLLFLFSSAYSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASSGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 324 - DNA, 1452 bp, Artificial Sequence
  source: /note="Description of Artificial Sequence: Synthetic polynucleotide"
atgaagtgggtgaccttcatcagcctgctgttcctgttctccagcgcctactcccagggccaggacaggcacatgatccggatgaggcagctcatcgacatcgtcgaccagctgaagaactacgtgaacgacctggtgcccgagtttctgcctgcccccgaggacgtggagaccaactgcgagtggtccgccttctcctgctttcagaaggcccagctgaagtccgccaacaccggcaacaacgagcggatcatcaacgtgagcatcaagaagctgaagcggaagcctccctccacaaacgccggcaggaggcagaagcacaggctgacctgccccagctgtgactcctacgagaagaagccccccaaggagttcctggagaggttcaagtccctgctgcagaagatgatccatcagcacctgtcctccaggacccacggctccgaggactcctccggcaccaccaataccgtggccgcttataacctcacatggaagagcaccaacttcgcgacagctctggaatgggaacccaagcccgtcaatcaagtttacaccgtgcagatctccaccaaatccggagactggaagagcaagtgcttctacacaacagacaccgagtgtgctttaaccgacgaaatcgtcaaggacgtcaagcaaacctatctggctcgggtcttttcctaccccgctggcaatgtcgagtccaccggctccgctggcgagcctctctacgagaattcccccgaattcaccccttatttagagaccaatttaggccagcctaccatccagagcttcgagcaagttggcaccaaggtgaacgtcaccgtcgaggatgaaaggactttagtggcgcggaataacacagctttatccctccgggatgtgttcggcaaagacctcatctacacactgtactattggaagtccagctcctccggcaaaaagaccgctaagaccaacaccaacgagtttttaattgacgtggacaaaggcgagaactactgcttcagcgtgcaagccgtgatcccttctcgtaccgtcaaccggaagagcacagattcccccgttgagtgcatgggccaagaaaagggcgagttccgggagaactgggtgaacgtcatcagcgatttaaagaagatcgaagatttaattcagtccatgcatatcgacgccactttatacacagaatccgacgtgcacccctcttgtaaggtgaccgccatgaaatgttttttactggagctgcaagttatctctttagagagcggagacgctagcatccacgacaccgtggagaatttaatcattttagccaataactctttatccagcaacggcaacgtgacagagtccggctgcaaggagtgcgaagagctggaggagaagaacatcaaggagtttctgcaatcctttgtgcacattgtccagatgttcatcaatacctcc

SEQ ID NO: 325 - protein, 484 aa, Artificial Sequence
  source: /note="Description of Artificial Sequence: Synthetic polypeptide"
MKWVTFISLLFLFSSAYSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDSSGTTNTVAAYNLTWKSTNFATALEWEPKPVNQVYTVQISTKSGDWKSKCFYTTDTECALTDEIVKDVKQTYLARVFSYPAGNVESTGSAGEPLYENSPEFTPYLETNLGQPTIQSFEQVGTKVNVTVEDERTLVARNNTALSLRDVFGKDLIYTLYYWKSSSSGKKTAKTNTNEFLIDVDKGENYCFSVQAVIPSRTVNRKSTDSPVECMGQEKGEFRENWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 326 - DNA, 2142 bp, Artificial Sequence; identical to SEQ ID NO: 92
  source: /note="Description of Artificial Sequence: Synthetic polynucleotide"

SEQ ID NO: 327 - protein, 714 aa, Artificial Sequence; identical to SEQ ID NO: 91
  source: /note="Description of Artificial Sequence: Synthetic polypeptide"

SEQ ID NO: 328 - protein, 17 aa, Artificial Sequence
  source: /note="Description of Artificial Sequence: Synthetic peptide"
MGVKVLFALICIAVAEA

SEQ ID NO: 329 - protein, 454 aa, Homo sapiens
MDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 330 - DNA, 1365 bp, Homo sapiens
ctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaa

SEQ ID NO: 331 - DNA, 1245 bp, Artificial Sequence; identical to SEQ ID NO: 271
  source: /note="Description of Artificial Sequence: Synthetic polynucleotide"

SEQ ID NO: 332 - protein, 415 aa, Artificial Sequence; identical to SEQ ID NO: 270
  source: /note="Description of Artificial Sequence: Synthetic polypeptide"

SEQ ID NO: 333 - DNA, 15 bp, Artificial Sequence
  source: /note="Description of Artificial Sequence: Synthetic oligonucleotide"
ggtgggtataatggg

SEQ ID NO: 334 - DNA, 25 bp, Artificial Sequence
  source: /note="Description of Artificial Sequence: Synthetic oligonucleotide"
attattttattttaaaaaatttgtg

SEQ ID NO: 335 - protein, 129 aa, Homo sapiens [sequence omitted]

SEQ ID NO: 336 - protein, 126 aa, Homo sapiens
QGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

What is claimed is:

1. A method of killing or reducing the number of treatment-induced senescent cells in a subject that has been previously diagnosed or identified as having an aging-related disease or an inflammatory disease, the method comprising administering to the subject a therapeutically effective amount of one or more agent(s) that result(s) in a decrease in the activation of a TGF-β receptor,
wherein the subject has not been previously diagnosed or identified as having cancer.

2. A method of decreasing the accumulation of treatment-induced senescent cells in a subject that has been previously diagnosed or identified as having an aging-related disease or an inflammatory disease, the method comprising administering to the subject a therapeutically effective amount of one or more agent(s) that result(s) in a decrease in the activation of a TGF-β receptor,
wherein the subject has not been previously diagnosed or identified as having cancer.

3. A method of decreasing a level of a marker of treatment-induced senescent cells in a subject that has been previously diagnosed or identified as having an aging-related disease or an inflammatory disease, the method comprising administering to the subject a therapeutically effective amount of one or more agent(s) that result(s) in a decrease in the activation of a TGF-β receptor,
wherein the subject has not been previously diagnosed or identified as having cancer.

4. A method of reducing the activity of treatment-induced senescent cells in a subject that has been previously diagnosed or identified as having an aging-related disease or an inflammatory disease, the method comprising administering to the subject a therapeutically effective amount of one or more agent(s) that result(s) in a decrease in the activation of a TGF-β receptor,
wherein the subject has not been previously diagnosed or identified as having cancer.

5. A method of decreasing levels and/or activity of one or more SASP factor(s) derived from treatment-induced senescent cells in a subject that has been previously diagnosed or identified as having an aging-related disease or an inflammatory disease, the method comprising administering to the subject a therapeutically effective amount of one or more agent(s) that result(s) in a decrease in the activation of a TGF-β receptor,
wherein the subject has not been previously diagnosed or identified as having cancer.

6. The method of claim 1, wherein the aging-related disease is inflamm-aging related.

7. The method of claim 1, wherein the aging-related disease is selected from the group consisting of: Alzheimer's disease, aneurysm, cystic fibrosis, fibrosis in pancreatitis, glaucoma, hypertension, inflammatory bowel disease, intervertebral disc degeneration, osteoarthritis, type 2 diabetes mellitus, adipose atrophy, lipodystrophy, atherosclerosis, cataracts, COPD, idiopathic pulmonary fibrosis, kidney transplant failure, liver fibrosis, loss of bone mass, myocardial infarction, sarcopenia, wound healing, alopecia, cardiomyocyte hypertrophy, Parkinson's disease, age-associated loss of lung tissue elasticity, age-related macular degeneration, cachexia, glomerulosclerosis, liver cirrhosis, NAFLD, osteoporosis, amyotrophic lateral sclerosis, Huntington's disease, spinocerebellar ataxia, multiple sclerosis, neurodegeneration, stroke, dementia, vascular disease, infection susceptibility, chronic inflammation, and renal dysfunction.

8. The method of claim 1, wherein the inflammatory disease is selected from the group consisting of: rheumatoid arthritis, inflammatory bowel disease, lupus erythematosus, lupus nephritis, diabetic nephropathy, CNS injury, Alzheimer's disease, Parkinson's disease, amyotrophic lateral sclerosis, Crohn's disease, multiple sclerosis, Guillain-Barre syndrome, psoriasis, Grave's disease, ulcerative colitis, nonalcoholic steatohepatitis, and mood disorders.

9. The method of claim 1, wherein the administration of the one or more agent(s) that result(s) in a decrease in the activation of a TGF-β receptor results in a decrease in the number or activity of treatment-induced senescent cells in a target tissue in the subject.

10. The method of claim 1, wherein at least one of the one or more agent(s) that result(s) in a decrease in the activation of a TGF-β receptor is a soluble TGF-β receptor, an extracellular domain of TGF-β receptor, an antibody that binds specifically to TGF-β, an antagonistic antibody that binds to a TGF-β receptor, an agent that binds to a LAP, or an agent that binds to a TGF-β/LAP complex.

11. The method of claim 10, wherein the one or more agent(s) that result(s) in a decrease in the activation of a TGF-β receptor decrease(s) the activation of a TGF-β receptor through binding to a LAP, or to a TGF-β/LAP complex.

12. The method of claim 1, wherein at least one of the one or more agent(s) that result(s) in a decrease in the activation of a TGF-β receptor is a multi-chain chimeric polypeptide comprising:
(a) a first chimeric polypeptide comprising:
(i) a first target-binding domain;
(ii) a soluble tissue factor domain; and
(iii) a first domain of a pair of affinity domains;
(b) a second chimeric polypeptide comprising:
(i) a second domain of a pair of affinity domains; and
(ii) a second target-binding domain,
wherein one or both of the first target-binding domain and the second target-binding domain binds specifically to a ligand of a TGF-β receptor; or
one or both of the first target-binding domain and the second target-binding domain is an antagonistic antigen-binding domain that binds specifically to a TGF-β receptor.

13. The method of claim 1, wherein at least one of the one or more agent(s) that result(s) in a decrease in the activation of a TGF-β receptor is a single-chain chimeric polypeptide comprising:
(i) a first target-binding domain;
(ii) a soluble tissue factor domain; and
(iii) a second target-binding domain,
wherein one or both of the first target-binding domain and the second target-binding domain binds specifically to a ligand of a TGF-β receptor; or
one or both of the first target-binding domain and the second target-binding domain is an antagonistic antigen-binding domain that binds specifically to a TGF-β receptor.

14. The method of claim 12, wherein:
the first target-binding domain comprises a sequence that is at least 80% identical to SEQ ID NO: 188;
the second target-binding domain comprises a sequence that is at least 80% identical to SEQ ID NO: 188;
the soluble tissue factor domain comprises a sequence that is at least 80% identical to SEQ ID NO: 93;
the first domain of the pair of affinity domains comprises a sequence that is at least 80% identical to SEQ ID NO: 115; and
the second domain of the pair of affinity domains comprises a sequence that is at least 80% identical to SEQ ID NO: 113.

15. The method of claim 12, wherein:
the first target-binding domain comprises a sequence that is at least 90% identical to SEQ ID NO: 188;
the second target-binding domain comprises a sequence that is at least 90% identical to SEQ ID NO: 188;
the soluble tissue factor domain comprises a sequence that is at least 90% identical to SEQ ID NO: 93;
the first domain of the pair of affinity domains comprises a sequence that is at least 90% identical to SEQ ID NO: 115; and
the second domain of the pair of affinity domains comprises a sequence that is at least 90% identical to SEQ ID NO: 113.

16. The method of claim 12, wherein:
the first target-binding domain comprises a sequence that is at least 96% identical to SEQ ID NO: 188;
the second target-binding domain comprises a sequence that is at least 96% identical to SEQ ID NO: 188;
the soluble tissue factor domain comprises a sequence that is at least 96% identical to SEQ ID NO: 93;
the first domain of the pair of affinity domains comprises a sequence that is at least 95% identical to SEQ ID NO: 115; and
the second domain of the pair of affinity domains comprises a sequence that is at least 95% identical to SEQ ID NO: 113.

17. The method of claim 12, wherein:
the first target-binding domain comprises SEQ ID NO: 188;
the second target-binding domain comprises SEQ ID NO: 188;
the soluble tissue factor domain comprises SEQ ID NO: 93;
the first domain of the pair of affinity domains comprises SEQ ID NO: 115; and
the second domain of the pair of affinity domains comprises SEQ ID NO: 113.

18. The method of claim 12, wherein:
the first chimeric polypeptide comprises a sequence that is at least 80% identical to SEQ ID NO: 236; and
the second chimeric polypeptide comprises a sequence that is at least 80% identical to SEQ ID NO: 193.

19. The method of claim 12, wherein:
the first chimeric polypeptide comprises a sequence that is at least 90% identical to SEQ ID NO: 236; and
the second chimeric polypeptide comprises a sequence that is at least 90% identical to SEQ ID NO: 193.

20. The method of claim 12, wherein:
the first chimeric polypeptide comprises a sequence that is at least 96% identical to SEQ ID NO: 236; and
the second chimeric polypeptide comprises a sequence that is at least 96% identical to SEQ ID NO: 193.

21. The method of claim 12, wherein:
the first chimeric polypeptide comprises SEQ ID NO: 236; and
the second chimeric polypeptide comprises SEQ ID NO: 193.

22. The method of claim 12, wherein:
the first chimeric polypeptide comprises SEQ ID NO: 238; and
the second chimeric polypeptide comprises SEQ ID NO: 195.

23. The method of claim 2, wherein the aging-related disease is inflamm-aging related.

24. The method of claim 2, wherein the aging-related disease is selected from the group consisting of: Alzheimer's disease, aneurysm, cystic fibrosis, fibrosis in pancreatitis, glaucoma, hypertension, inflammatory bowel disease, intervertebral disc degeneration, osteoarthritis, type 2 diabetes mellitus, adipose atrophy, lipodystrophy, atherosclerosis, cataracts, COPD, idiopathic pulmonary fibrosis, kidney transplant failure, liver fibrosis, loss of bone mass, myocardial infarction, sarcopenia, wound healing, alopecia, cardiomyocyte hypertrophy, Parkinson's disease, age-associated loss of lung tissue elasticity, age-related macular degeneration, cachexia, glomerulosclerosis, liver cirrhosis, NAFLD, osteoporosis, amyotrophic lateral sclerosis, Huntington's disease, spinocerebellar ataxia, multiple sclerosis, neurodegeneration, stroke, dementia, vascular disease, infection susceptibility, chronic inflammation, and renal dysfunction.

25. The method of claim 2, wherein the inflammatory disease is selected from the group consisting of: rheumatoid arthritis, inflammatory bowel disease, lupus erythematosus, lupus nephritis, diabetic nephropathy, CNS injury, Alzheimer's disease, Parkinson's disease, amyotrophic lateral sclerosis, Crohn's disease, multiple sclerosis, Guillain-Barre syndrome, psoriasis, Grave's disease, ulcerative colitis, non-alcoholic steatohepatitis, and mood disorders.

26. The method of claim 2, wherein at least one of the one or more agent(s) that result(s) in a decrease in the activation of a TGF-β receptor is a multi-chain chimeric polypeptide comprising:
(a) a first chimeric polypeptide comprising:
(i) a first target-binding domain;
(ii) a soluble tissue factor domain; and
(iii) a first domain of a pair of affinity domains;
(b) a second chimeric polypeptide comprising:
(i) a second domain of a pair of affinity domains; and
(ii) a second target-binding domain,
wherein one or both of the first target-binding domain and the second target-binding domain binds specifically to a ligand of a TGF-β receptor; or
one or both of the first target-binding domain and the second target-binding domain is an antagonistic antigen-binding domain that binds specifically to a TGF-β receptor.

27. The method of claim 26, wherein:
the first target-binding domain comprises a sequence that is at least 80% identical to SEQ ID NO: 188;
the second target-binding domain comprises a sequence that is at least 80% identical to SEQ ID NO: 188;
the soluble tissue factor domain comprises a sequence that is at least 80% identical to SEQ ID NO: 93;
the first domain of the pair of affinity domains comprises a sequence that is at least 80% identical to SEQ ID NO: 115; and
the second domain of the pair of affinity domains comprises a sequence that is at least 80% identical to SEQ ID NO: 113.

28. The method of claim 26, wherein:
the first target-binding domain comprises a sequence that is at least 90% identical to SEQ ID NO: 188;
the second target-binding domain comprises a sequence that is at least 90% identical to SEQ ID NO: 188;
the soluble tissue factor domain comprises a sequence that is at least 90% identical to SEQ ID NO: 93;
the first domain of the pair of affinity domains comprises a sequence that is at least 90% identical to SEQ ID NO: 115; and
the second domain of the pair of affinity domains comprises a sequence that is at least 90% identical to SEQ ID NO: 113.

29. The method of claim 26, wherein:
the first target-binding domain comprises a sequence that is at least 96% identical to SEQ ID NO: 188;
the second target-binding domain comprises a sequence that is at least 96% identical to SEQ ID NO: 188;
the soluble tissue factor domain comprises a sequence that is at least 96% identical to SEQ ID NO: 93;
the first domain of the pair of affinity domains comprises a sequence that is at least 95% identical to SEQ ID NO: 115; and
the second domain of the pair of affinity domains comprises a sequence that is at least 95% identical to SEQ ID NO: 113.

30. The method of claim 26, wherein:
the first target-binding domain comprises SEQ ID NO: 188;
the second target-binding domain comprises SEQ ID NO: 188;
the soluble tissue factor domain comprises SEQ ID NO: 93;
the first domain of the pair of affinity domains comprises SEQ ID NO: 115; and
the second domain of the pair of affinity domains comprises SEQ ID NO: 113.

31. The method of claim 26, wherein:
the first chimeric polypeptide comprises a sequence that is at least 80% identical to SEQ ID NO: 236; and
the second chimeric polypeptide comprises a sequence that is at least 80% identical to SEQ ID NO: 193.

32. The method of claim 26, wherein:
the first chimeric polypeptide comprises a sequence that is at least 90% identical to SEQ ID NO: 236; and
the second chimeric polypeptide comprises a sequence that is at least 90% identical to SEQ ID NO: 193.

33. The method of claim 26, wherein:
the first chimeric polypeptide comprises a sequence that is at least 96% identical to SEQ ID NO: 236; and
the second chimeric polypeptide comprises a sequence that is at least 96% identical to SEQ ID NO: 193.

34. The method of claim 26, wherein:
the first chimeric polypeptide comprises SEQ ID NO: 236; and
the second chimeric polypeptide comprises SEQ ID NO: 193.

35. The method of claim 26, wherein:
the first chimeric polypeptide comprises SEQ ID NO: 238; and
the second chimeric polypeptide comprises SEQ ID NO: 195.

36. The method of claim 2, wherein at least one of the one or more agent(s) that result(s) in a decrease in the activation of a TGF-β receptor is a single-chain chimeric polypeptide comprising:
(i) a first target-binding domain;
(ii) a soluble tissue factor domain; and
(iii) a second target-binding domain,
wherein one or both of the first target-binding domain and the second target-binding domain binds specifically to a ligand of a TGF-β receptor; or
one or both of the first target-binding domain and the second target-binding domain is an antagonistic antigen-binding domain that binds specifically to a TGF-β receptor.

37. The method of claim 3, wherein the aging-related disease is inflamm-aging related.

38. The method of claim 3, wherein the aging-related disease is selected from the group consisting of: Alzheimer's disease, aneurysm, cystic fibrosis, fibrosis in pancreatitis, glaucoma, hypertension, inflammatory bowel disease, intervertebral disc degeneration, osteoarthritis, type 2 diabetes mellitus, adipose atrophy, lipodystrophy, atherosclerosis, cataracts, COPD, idiopathic pulmonary fibrosis, kidney transplant failure, liver fibrosis, loss of bone mass, myocardial infarction, sarcopenia, wound healing, alopecia, cardiomyocyte hypertrophy, Parkinson's disease, age-associated loss of lung tissue elasticity, age-related macular degeneration, cachexia, glomerulosclerosis, liver cirrhosis, NAFLD, osteoporosis, amyotrophic lateral sclerosis, Huntington's disease, spinocerebellar ataxia, multiple sclerosis, neurodegeneration, stroke, dementia, vascular disease, infection susceptibility, chronic inflammation, and renal dysfunction.

39. The method of claim 3, wherein the inflammatory disease is selected from the group consisting of: rheumatoid arthritis, inflammatory bowel disease, lupus erythematosus, lupus nephritis, diabetic nephropathy, CNS injury, Alzheimer's disease, Parkinson's disease, amyotrophic lateral sclerosis, Crohn's disease, multiple sclerosis, Guillain-Barre syndrome, psoriasis, Grave's disease, ulcerative colitis, non-alcoholic steatohepatitis, and mood disorders.

40. The method of claim 3, wherein at least one of the one or more agent(s) that result(s) in a decrease in the activation of a TGF-β receptor is a multi-chain chimeric polypeptide comprising:
(c) a first chimeric polypeptide comprising:
(i) a first target-binding domain;
(ii) a soluble tissue factor domain; and
(iii) a first domain of a pair of affinity domains;
(d) a second chimeric polypeptide comprising:
(i) a second domain of a pair of affinity domains; and
(ii) a second target-binding domain,
wherein one or both of the first target-binding domain and the second target-binding domain binds specifically to a ligand of a TGF-β receptor; or one or both of the first target-binding domain and the second target-binding domain is an antagonistic antigen-binding domain that binds specifically to a TGF-β receptor.

41. The method of claim 40, wherein:
the first target-binding domain comprises a sequence that is at least 80% identical to SEQ ID NO: 188;
the second target-binding domain comprises a sequence that is at least 80% identical to SEQ ID NO: 188;
the soluble tissue factor domain comprises a sequence that is at least 80% identical to SEQ ID NO: 93;
the first domain of the pair of affinity domains comprises a sequence that is at least 80% identical to SEQ ID NO: 115; and
the second domain of the pair of affinity domains comprises a sequence that is at least 80% identical to SEQ ID NO: 113.

42. The method of claim 40, wherein:
the first target-binding domain comprises a sequence that is at least 90% identical to SEQ ID NO: 188;
the second target-binding domain comprises a sequence that is at least 90% identical to SEQ ID NO: 188;
the soluble tissue factor domain comprises a sequence that is at least 90% identical to SEQ ID NO: 93;
the first domain of the pair of affinity domains comprises a sequence that is at least 90% identical to SEQ ID NO: 115; and
the second domain of the pair of affinity domains comprises a sequence that is at least 90% identical to SEQ ID NO: 113.

43. The method of claim 40, wherein:
the first target-binding domain comprises a sequence that is at least 96% identical to SEQ ID NO: 188;
the second target-binding domain comprises a sequence that is at least 96% identical to SEQ ID NO: 188;
the soluble tissue factor domain comprises a sequence that is at least 96% identical to SEQ ID NO: 93;
the first domain of the pair of affinity domains comprises a sequence that is at least 95% identical to SEQ ID NO: 115; and
the second domain of the pair of affinity domains comprises a sequence that is at least 95% identical to SEQ ID NO: 113.

44. The method of claim 40, wherein:
the first target-binding domain comprises SEQ ID NO: 188;
the second target-binding domain comprises SEQ ID NO: 188;
the soluble tissue factor domain comprises SEQ ID NO: 93;
the first domain of the pair of affinity domains comprises SEQ ID NO: 115; and
the second domain of the pair of affinity domains comprises SEQ ID NO: 113.

45. The method of claim 40, wherein:
the first chimeric polypeptide comprises a sequence that is at least 80% identical to SEQ ID NO: 236; and
the second chimeric polypeptide comprises a sequence that is at least 80% identical to SEQ ID NO: 193.

46. The method of claim 40, wherein:
the first chimeric polypeptide comprises a sequence that is at least 90% identical to SEQ ID NO: 236; and
the second chimeric polypeptide comprises a sequence that is at least 90% identical to SEQ ID NO: 193.

47. The method of claim 40, wherein:
the first chimeric polypeptide comprises a sequence that is at least 96% identical to SEQ ID NO: 236; and
the second chimeric polypeptide comprises a sequence that is at least 96% identical to SEQ ID NO: 193.

48. The method of claim 40, wherein:
the first chimeric polypeptide comprises SEQ ID NO: 236; and
the second chimeric polypeptide comprises SEQ ID NO: 193.

49. The method of claim 40, wherein:
the first chimeric polypeptide comprises SEQ ID NO: 238; and
the second chimeric polypeptide comprises SEQ ID NO: 195.

50. The method of claim 3, wherein at least one of the one or more agent(s) that result(s) in a decrease in the activation of a TGF-β receptor is a single-chain chimeric polypeptide comprising:
(i) a first target-binding domain;
(ii) a soluble tissue factor domain; and
(iii) a second target-binding domain,
wherein one or both of the first target-binding domain and the second target-binding domain binds specifically to a ligand of a TGF-β receptor; or
one or both of the first target-binding domain and the second target-binding domain is an antagonistic antigen-binding domain that binds specifically to a TGF-β receptor.

51. The method of claim 4, wherein the aging-related disease is inflamm-aging related.

52. The method of claim 4, wherein the aging-related disease is selected from the group consisting of: Alzheimer's disease, aneurysm, cystic fibrosis, fibrosis in pancreatitis, glaucoma, hypertension, inflammatory bowel disease, intervertebral disc degeneration, osteoarthritis, type 2 diabetes mellitus, adipose atrophy, lipodystrophy, atherosclerosis, cataracts, COPD, idiopathic pulmonary fibrosis, kidney transplant failure, liver fibrosis, loss of bone mass, myocardial infarction, sarcopenia, wound healing, alopecia, cardiomyocyte hypertrophy, Parkinson's disease, age-associated loss of lung tissue elasticity, age-related macular degeneration, cachexia, glomerulosclerosis, liver cirrhosis, NAFLD, osteoporosis, amyotrophic lateral sclerosis, Huntington's disease, spinocerebellar ataxia, multiple sclerosis, neurodegeneration, stroke, dementia, vascular disease, infection susceptibility, chronic inflammation, and renal dysfunction.

53. The method of claim 4, wherein the inflammatory disease is selected from the group consisting of: rheumatoid arthritis, inflammatory bowel disease, lupus erythematosus, lupus nephritis, diabetic nephropathy, CNS injury, Alzheimer's disease, Parkinson's disease, amyotrophic lateral sclerosis, Crohn's disease, multiple sclerosis, Guillain-Barre syndrome, psoriasis, Grave's disease, ulcerative colitis, non-alcoholic steatohepatitis, and mood disorders.

54. The method of claim 4, wherein at least one of the one or more agent(s) that result(s) in a decrease in the activation of a TGF-β receptor is a multi-chain chimeric polypeptide comprising:
(e) a first chimeric polypeptide comprising:
(i) a first target-binding domain;
(ii) a soluble tissue factor domain; and
(iii) a first domain of a pair of affinity domains;
(f) a second chimeric polypeptide comprising:
(i) a second domain of a pair of affinity domains; and
(ii) a second target-binding domain,
wherein one or both of the first target-binding domain and the second target-binding domain binds specifically to a ligand of a TGF-β receptor; or one or both of the first target-binding domain and the second target-binding domain is an antagonistic antigen-binding domain that binds specifically to a TGF-β receptor.

55. The method of claim 54, wherein:
the first target-binding domain comprises a sequence that is at least 80% identical to SEQ ID NO: 188;
the second target-binding domain comprises a sequence that is at least 80% identical to SEQ ID NO: 188;
the soluble tissue factor domain comprises a sequence that is at least 80% identical to SEQ ID NO: 93;
the first domain of the pair of affinity domains comprises a sequence that is at least 80% identical to SEQ ID NO: 115; and
the second domain of the pair of affinity domains comprises a sequence that is at least 80% identical to SEQ ID NO: 113.

56. The method of claim 54, wherein:
the first target-binding domain comprises a sequence that is at least 90% identical to SEQ ID NO: 188;
the second target-binding domain comprises a sequence that is at least 90% identical to SEQ ID NO: 188;
the soluble tissue factor domain comprises a sequence that is at least 90% identical to SEQ ID NO: 93;
the first domain of the pair of affinity domains comprises a sequence that is at least 90% identical to SEQ ID NO: 115; and
the second domain of the pair of affinity domains comprises a sequence that is at least 90% identical to SEQ ID NO: 113.

57. The method of claim 54, wherein:
the first target-binding domain comprises a sequence that is at least 96% identical to SEQ the second target-binding domain comprises a sequence that is at least 96% identical to SEQ ID NO: 188;
the soluble tissue factor domain comprises a sequence that is at least 96% identical to SEQ ID NO: 93;
the first domain of the pair of affinity domains comprises a sequence that is at least 95% identical to SEQ ID NO: 115; and
the second domain of the pair of affinity domains comprises a sequence that is at least 95% identical to SEQ ID NO: 113.

58. The method of claim 54, wherein:
the first target-binding domain comprises SEQ ID NO: 188;
the second target-binding domain comprises SEQ ID NO: 188;
the soluble tissue factor domain comprises SEQ ID NO: 93;
the first domain of the pair of affinity domains comprises SEQ ID NO: 115; and
the second domain of the pair of affinity domains comprises SEQ ID NO: 113.

59. The method of claim 54, wherein:
the first chimeric polypeptide comprises a sequence that is at least 80% identical to SEQ ID NO: 236; and
the second chimeric polypeptide comprises a sequence that is at least 80% identical to SEQ ID NO: 193.

60. The method of claim 54, wherein:
the first chimeric polypeptide comprises a sequence that is at least 90% identical to SEQ ID NO: 236; and
the second chimeric polypeptide comprises a sequence that is at least 90% identical to SEQ ID NO: 193.

61. The method of claim 54, wherein:
the first chimeric polypeptide comprises a sequence that is at least 96% identical to SEQ ID NO: 236; and
the second chimeric polypeptide comprises a sequence that is at least 96% identical to SEQ ID NO: 193.

62. The method of claim 54, wherein:
the first chimeric polypeptide comprises SEQ ID NO: 236; and
the second chimeric polypeptide comprises SEQ ID NO: 193.

63. The method of claim 54, wherein:
the first chimeric polypeptide comprises SEQ ID NO: 238; and
the second chimeric polypeptide comprises SEQ ID NO: 195.

64. The method of claim 4, wherein at least one of the one or more agent(s) that result(s) in a decrease in the activation of a TGF-β receptor is a single-chain chimeric polypeptide comprising:
(i) a first target-binding domain;
(ii) a soluble tissue factor domain; and
(iii) a second target-binding domain,
wherein one or both of the first target-binding domain and the second target-binding domain binds specifically to a ligand of a TGF-β receptor; or
one or both of the first target-binding domain and the second target-binding domain is an antagonistic antigen-binding domain that binds specifically to a TGF-β receptor.

65. The method of claim 5, wherein the aging-related disease is inflamm-aging related.

66. The method of claim 5, wherein the aging-related disease is selected from the group consisting of: Alzheimer's disease, aneurysm, cystic fibrosis, fibrosis in pancreatitis, glaucoma, hypertension, inflammatory bowel disease, intervertebral disc degeneration, osteoarthritis, type 2 diabetes mellitus, adipose atrophy, lipodystrophy, atherosclerosis, cataracts, COPD, idiopathic pulmonary fibrosis, kidney transplant failure, liver fibrosis, loss of bone mass, myocardial infarction, sarcopenia, wound healing, alopecia, cardiomyocyte hypertrophy, Parkinson's disease, age-associated loss of lung tissue elasticity, age-related macular degeneration, cachexia, glomerulosclerosis, liver cirrhosis, NAFLD, osteoporosis, amyotrophic lateral sclerosis, Huntington's disease, spinocerebellar ataxia, multiple sclerosis, neurodegeneration, stroke, dementia, vascular disease, infection susceptibility, chronic inflammation, and renal dysfunction.

67. The method of claim 5, wherein the inflammatory disease is selected from the group consisting of: rheumatoid arthritis, inflammatory bowel disease, lupus erythematosus, lupus nephritis, diabetic nephropathy, CNS injury, Alzheimer's disease, Parkinson's disease, amyotrophic lateral sclerosis, Crohn's disease, multiple sclerosis, Guillain-Barre syndrome, psoriasis, Grave's disease, ulcerative colitis, non-alcoholic steatohepatitis, and mood disorders.

68. The method of claim 5, wherein at least one of the one or more agent(s) that result(s) in a decrease in the activation of a TGF-β receptor is a multi-chain chimeric polypeptide comprising:
(g) a first chimeric polypeptide comprising:
(i) a first target-binding domain;
(ii) a soluble tissue factor domain; and
(iii) a first domain of a pair of affinity domains;
(h) a second chimeric polypeptide comprising:
(i) a second domain of a pair of affinity domains; and
(ii) a second target-binding domain,
wherein one or both of the first target-binding domain and the second target-binding domain binds specifically to a ligand of a TGF-β receptor; or one or both of the first target-binding domain and the second target-binding domain is an antagonistic antigen-binding domain that binds specifically to a TGF-β receptor.

69. The method of claim 68, wherein:
the first target-binding domain comprises a sequence that is at least 80% identical to SEQ ID NO: 188;
the second target-binding domain comprises a sequence that is at least 80% identical to SEQ ID NO: 188;
the soluble tissue factor domain comprises a sequence that is at least 80% identical to SEQ ID NO: 93;
the first domain of the pair of affinity domains comprises a sequence that is at least 80% identical to SEQ ID NO: 115; and
the second domain of the pair of affinity domains comprises a sequence that is at least 80% identical to SEQ ID NO: 113.

70. The method of claim 68, wherein:
the first target-binding domain comprises a sequence that is at least 90% identical to SEQ ID NO: 188;
the second target-binding domain comprises a sequence that is at least 90% identical to SEQ ID NO: 188;
the soluble tissue factor domain comprises a sequence that is at least 90% identical to SEQ ID NO: 93;
the first domain of the pair of affinity domains comprises a sequence that is at least 90% identical to SEQ ID NO: 115; and
the second domain of the pair of affinity domains comprises a sequence that is at least 90% identical to SEQ ID NO: 113.

71. The method of claim 68, wherein:
the first target-binding domain comprises a sequence that is at least 96% identical to SEQ the second target-binding domain comprises a sequence that is at least 96% identical to SEQ ID NO: 188;
the soluble tissue factor domain comprises a sequence that is at least 96% identical to SEQ ID NO: 93;
the first domain of the pair of affinity domains comprises a sequence that is at least 95% identical to SEQ ID NO: 115; and
the second domain of the pair of affinity domains comprises a sequence that is at least 95% identical to SEQ ID NO: 113.

72. The method of claim 68, wherein:
the first target-binding domain comprises SEQ ID NO: 188;
the second target-binding domain comprises SEQ ID NO: 188;
the soluble tissue factor domain comprises SEQ ID NO: 93;
the first domain of the pair of affinity domains comprises SEQ ID NO: 115; and
the second domain of the pair of affinity domains comprises SEQ ID NO: 113.

73. The method of claim 68, wherein:
the first chimeric polypeptide comprises a sequence that is at least 80% identical to SEQ ID NO: 236; and
the second chimeric polypeptide comprises a sequence that is at least 80% identical to SEQ ID NO: 193.

74. The method of claim 68, wherein:
the first chimeric polypeptide comprises a sequence that is at least 90% identical to SEQ ID NO: 236; and
the second chimeric polypeptide comprises a sequence that is at least 90% identical to SEQ ID NO: 193.

75. The method of claim 68, wherein:
the first chimeric polypeptide comprises a sequence that is at least 96% identical to SEQ ID NO: 236; and
the second chimeric polypeptide comprises a sequence that is at least 96% identical to SEQ ID NO: 193.

76. The method of claim 68, wherein:
the first chimeric polypeptide comprises SEQ ID NO: 236; and
the second chimeric polypeptide comprises SEQ ID NO: 193.

77. The method of claim 68, wherein:
the first chimeric polypeptide comprises SEQ ID NO: 238; and
the second chimeric polypeptide comprises SEQ ID NO: 195.

78. The method of claim 5, wherein at least one of the one or more agent(s) that result(s) in a decrease in the activation of a TGF-β receptor is a single-chain chimeric polypeptide comprising:
(i) a first target-binding domain;
(ii) a soluble tissue factor domain; and
(iii) a second target-binding domain,
wherein one or both of the first target-binding domain and the second target-binding domain binds specifically to a ligand of a TGF-β receptor; or
one or both of the first target-binding domain and the second target-binding domain is an antagonistic antigen-binding domain that binds specifically to a TGF-β receptor.

* * * * *